(12) United States Patent
Hu et al.

(10) Patent No.: US 9,068,201 B2
(45) Date of Patent: *Jun. 30, 2015

(54) METHODS AND COMPOSITIONS FOR PRODUCING FATTY ALCOHOLS

(71) Applicant: Reg Life Sciences, LLC, Ames, IA (US)

(72) Inventors: Zhihao Hu, South San Francisco, CA (US); Vikranth Arlagadda, South San Francisco, CA (US)

(73) Assignee: REG Life Sciences, LLC., South San Francisco, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/647,185

(22) Filed: Oct. 8, 2012

(65) Prior Publication Data

US 2013/0115665 A1     May 9, 2013

Related U.S. Application Data

(63) Continuation-in-part of application No. 12/575,430, filed on Oct. 7, 2009.

(60) Provisional application No. 61/109,131, filed on Oct. 28, 2008.

(51) Int. Cl.
| | |
|---|---|
| C12N 9/02 | (2006.01) |
| A61K 31/045 | (2006.01) |
| A61K 9/42 | (2006.01) |
| C12P 7/04 | (2006.01) |
| C12N 1/20 | (2006.01) |
| A61K 38/00 | (2006.01) |
| C12R 1/01 | (2006.01) |

(52) U.S. Cl.
CPC ... *C12P 7/04* (2013.01); *C12N 1/20* (2013.01); *C12N 9/0004* (2013.01); *C12N 2501/71* (2013.01); *C12N 2502/99* (2013.01); *A61K 31/045* (2013.01); *C12R 1/01* (2013.01)

(58) Field of Classification Search
CPC ........... C12N 2501/71; C12N 2009/02; C12N 9/0004; C12N 2502/99
See application file for complete search history.

(56) References Cited

U.S. PATENT DOCUMENTS

| | | |
|---|---|---|
| 5,000,000 A | 3/1991 | Ingram et al. |
| 5,028,539 A | 7/1991 | Ingram et al. |
| 5,424,202 A | 6/1995 | Ingram et al. |
| 5,482,846 A | 1/1996 | Ingram et al. |
| 5,602,030 A | 2/1997 | Ingram et al. |
| 5,807,893 A | 9/1998 | Voelker et al. |
| 6,583,266 B1* | 6/2003 | Smith et al. ................... 530/350 |
| 7,056,714 B2 | 6/2006 | Rosazza et al. |
| 7,118,896 B2 | 10/2006 | Kalscheuer et al. |
| 7,169,588 B2 | 1/2007 | Burch et al. |
| 7,425,433 B2 | 9/2008 | Rosazza et al. |
| 7,491,854 B2 | 2/2009 | Binder |
| 7,608,700 B2 | 10/2009 | Klaenhammer et al. |
| 8,110,670 B2* | 2/2012 | Hu et al. ....................... 536/23.2 |
| 8,323,924 B2* | 12/2012 | Schirmer et al. ................. 435/41 |
| 2003/0064328 A1* | 4/2003 | Friedel .......................... 430/350 |
| 2003/0097686 A1 | 5/2003 | Knauf et al. |
| 2003/0129601 A1 | 7/2003 | Cole |
| 2003/0233675 A1 | 12/2003 | Cao et al. |
| 2004/0180400 A1 | 9/2004 | Rosazza et al. |
| 2004/0197896 A1 | 10/2004 | Cole |
| 2005/0019863 A1* | 1/2005 | Sarmientos et al. ......... 435/69.1 |
| 2005/0250135 A1 | 11/2005 | Klaenhammer et al. |
| 2007/0281345 A1 | 12/2007 | Binder |
| 2008/0221310 A1 | 9/2008 | O'Sullivan et al. |
| 2008/0295388 A1 | 12/2008 | Bazzani et al. |
| 2009/0084025 A1 | 4/2009 | Bhatia et al. |
| 2009/0136469 A1* | 5/2009 | Senin et al. ................. 424/93.51 |
| 2009/0275097 A1 | 11/2009 | Sun et al. |
| 2010/0105955 A1 | 4/2010 | Alibhai et al. |
| 2010/0105963 A1 | 4/2010 | Hu et al. |
| 2010/0154293 A1 | 6/2010 | Hom et al. |
| 2010/0221798 A1 | 9/2010 | Schirmer et al. |
| 2010/0242345 A1 | 9/2010 | Keasling et al. |
| 2010/0249470 A1 | 9/2010 | Schirmer et al. |
| 2010/0251601 A1 | 10/2010 | Hu et al. |
| 2010/0274033 A1* | 10/2010 | Sanchez-Riera et al. ......... 554/1 |
| 2011/0097769 A1* | 4/2011 | Del Cardayre et al. ....... 435/134 |
| 2012/0040426 A1 | 2/2012 | Sun et al. |
| 2013/0084608 A1* | 4/2013 | Szabo et al. .................... 435/99 |

FOREIGN PATENT DOCUMENTS

| | | |
|---|---|---|
| WO | WO 2004081226 A2 * | 9/2004 |
| WO | WO 2007/003736 A1 | 1/2007 |
| WO | WO 2007/136762 A2 | 11/2007 |
| WO | WO 2008/058788 | 5/2008 |
| WO | WO 2008/119082 A2 | 10/2008 |
| WO | WO 2009/042950 A1 | 4/2009 |

(Continued)

OTHER PUBLICATIONS

SEQ Align 22 (2013) Atttached sequence alignment for SEQ ID No. 2 from the search results, pp. 1-3.*

Abbadi et al., "Knockout of the regulatory site of 3-ketoacyl-ACP synthase III enhances short-and medium-chain acyl-ACP synthesis", *Plant Journal*, 24(1): 1-9 (2000).

Abdel-Hamid et al., "Coordinate Expression of the Acetyl Coenzyme A Carboxylase Genes, accB and accC, Is Necessary for Normal Regulation of Biotin Synthesis in *Escherichia coli*", *J. Bacteriol.*, 189:369-376 (2007).

(Continued)

*Primary Examiner* — Manjunath Rao
*Assistant Examiner* — Samuel Liu
(74) *Attorney, Agent, or Firm* — Brigitte A. Hajos; REG Life Sciences LLC

(57) ABSTRACT

Methods and compositions, including nucleotide sequences, amino acid sequences, and host cells, for producing fatty alcohols are described.

18 Claims, 153 Drawing Sheets

(56) References Cited

FOREIGN PATENT DOCUMENTS

| WO | WO 2009/140695 | 11/2009 |
|---|---|---|
| WO | WO 2009/140696 | 11/2009 |
| WO | WO 2010/042664 | 4/2010 |
| WO | WO 2010/062480 A2 | 6/2010 |
| WO | WO 2011/062987 A2 | 5/2011 |
| WO | WO 2010/075483 A1 | 7/2011 |

OTHER PUBLICATIONS

Abdel-Hamid et al., "Pyruvate oxidase contributes to the aerobic growth efficiency of *Escherichia coli*," Microbiol. 147(6):1483-98 (2001).
Alper, et al., "Engineering for biofuels: exploiting innate microbial capacity or importing biosynthetic potential?", *NRM* 7: 715-723 (2009).
Atsumi et al., "Metabolic engineering for advanced biofuels production from *Escherichia coli*", *Current Opin.Biotech*, 19:414-419 (2008).
Atsumi et al., "Metabolic engineering of *Escherichia coli* for 1-butanol production", *Metabolic Enginering* 10:305-311 (2008).
Atsumi et al., "Non-fermentative pathways for synthesis of branched-chain higher alcohols as biofuels", *Nature*, 451: 86-89 (2008).
Barnes, Jr. et al., "Studies on the Mechanism of Fatty Acid Synthesis. XIX. Preparation and General Properties of Palmityl Thioesterase", *J. Biol. Chem.*, 243(11):2955-2962 (1968).
Bergler et al., "Protein EnvM is the NADH-dependent Enoyl-ACP Reductase (FabI) of *Escherichia coli*," *J. Biol. Chem.*, 269(8): 5943-5946 (1994).
Bergler et al., "The enoyl-[acyl-carrier-protein] reductase (FabI) of *Escherichia coli*, which catalyzes a key regulatory step in fatty acid biosynthesis, accepts NADH and NADPH as cofactors and is inhibited by palmitoyl-CoA", *Eur. J. Biochem.* 242: 689-694 (1996).
Berrios-Rivera et al., "The Effect of Increasing NADH Availability on the Redistribution of Metabolic Fluxes in *Escherichia coli* Chemostat Cultures", *Metabolic Engineering* 4: 230-237 (2002).
Birge et al., "Acyl Carrier Protein. XVI.Intermediate Reactions of Unsaturated Fatty Acid Synthesis in *Escerichia coli* and Studies of fab B Mutants", J.Biol.Chem. 247(16): 4921-4929 (1972).
Black et al., "Cloning, Sequencing, and Expression of the fadD Gene of *Escherichia coli* Encoding Acyl Coenzyme A Synthetase," *J. Biol. Chem.* 267(35): 25513-25520 (1992).
Black, P., "Primary Sequence of the *Escherichia coli* fadL Gene Encoding an Outer Membrane Protein Required for Long-Chain Fatty Acid Transport", *J. Bacteriololgy* 173(2): 435-442 (1991).
Black et al., "Mutational Analysis of a Fatty Acyl-Coenzyme A Synthetase Signature Motif Identifies Seven Amino Acid Residues That Modulate Fatty Acid Substrate Specificity", *J. Biol. Chem.* 272(8) 4896-4903 (1997).
Black et al., "Long-Chain Acyl-CoA—Dependent Regulation of Gene Expression in Bacteria, Yeast and Mammals", *J. Nutrition*, 305S-309S (2000).
Blanchard et al., "Overexpression and Kinetic Characterization of the Carboxyltransferase Component of Acetyl-CoA Carboxylase", *J.Biol.Chem.* 273(30): 19140-19145 (1998).
Bonamore et al., "The desaturase from *Bacillus subtilis*, a promising tool for the selective olefination of phospholipids", *J.Biotechnology* 121: 49-53 (2006).
Bond-Watts et al., "Enzyme mechanism as a kinetic control element for designing synthetic biofuel pathways", *Nature Chem Bio* 537: 1-6 (Suppl. S1-S28) (2011).
Bonner et a.l, "Purification and Properties of Fatty Acyl Thioesterase I from *Escherichia coli*", *J.Biol.Chem.* 247(10): 3123-3133 (1972).
Boonstra et al., "The udhA Gene of *Escherichia coli* Encodes a Soluble Pyridine Nucleotide Transhydrogenase", *J. Bacteriol.* 181(3): 1030-1034 (1999).
Boulanger et al., "Purification and Structrual and Functional Characterization of FhuA, a Transporter of the *Escherichia coli* Outer Membrane," *Biochemistry*, 35(45): 14216-14224 (1996).

Bredwell et al., "Reactor Design Issues for Synthesis-Gas Fermentations", *Biotechnol. Prog. 15*: 834-844 (1999).
Broun et al., "Catalytic Plasticity of Fatty Acid Modification Enzymes Underlying Chemical Diversity of Plant Llipids", *Science* 282: 1315-1317 (1998).
Bunch et al., "The IdhA gene encoding the fermentative lactate dehydrogenase of *Escherichia coli*," Microbiol. 143(1):187-95 (1997).
Cahoon et al., "Modification of the Fatty Acid Composition of *Escherichia coli* by Coexpression of a Plant Acyl-Acyl Carrier Protein Desaturase and Ferredoxin", *J.Bacteriol.* 178(3): 936-936 (1996).
Cahoon et al., "Redesign of soluble fatty acid desaturases from plants for altered substrate specificity and double bond position", *Proc. Natl. Acad. Sci.94*: 4872-4877 (1997).
Cahoon et al., "A Determinant of Substrate Specificity Predicted from the Acyl-Acyl Carrier Protein Desaturase of Developing Cat's Claw Seed", *Plant Physiol 117*: 593-598 (1998).
Campbell et al., "The Enigmatic *Escherichia coli* neu Gene is yafH" *J. Bacteriol.*, 184(13): 3759-3764 (2002).
Campbell et al., "A New *Escherichia coli* metabolic competency: growth on fatty acids by a novel anaerobic β-oxidation pathway," *Mol. Microbiol.*, 47(3): 793-805 (2003).
Campbell et al., "*Escherichia coli* FadR Positively Regulates Transcription of the fabB Fatty Acid Biosynthetic Gene", *J.Bacteriol.* 183(20): 5982-5990 (2001).
Caviglia et al., "Rat Long Chain Acyl-CoA Synthetase 5, but Not 1, 2, 3, or 4, Complements *Escherichia coli* fadD," J. Biol. Chem., 279(12): 11163-11169 (2004).
Chang et al., "Genetic and Biochemical Analyses of *Escherichia coli* Strains Having a Mutation in the Structural Gene (poxB) for Pyruvate Oxidase," *J. Bacteriol.*, 154(2): 756-62 (1983).
Chen, et al., "Biosynthesis of Ansatrienin (mycotrienin) and naphthomycin, Identification and Analysis of Two Separate Biosynthetic Gene Clusters in *Streptomyces collinus* Tu 1892," Eur. J. Biochem. 261, 1999, pp. 98-107, 10 pages.
Cheng, J. et al., "Mammalian Wax Biosynthesis," J. Biol. Chem. 279(36):37798-37807, 2004.
Cho et al., "Defective Export of a Periplasmic Enzyme Disrupts Regulation of Fatty Acid Synthesis," *J. Biol. Chem.*, 270: 4216-4219 (1995).
Cho et al., "*Escherichia coli* Thioesterase I, Molecular Cloning and Sequencing of the Structural Gene and Identification as a Periplasmic Enzyme", *J.Biol.Chem* 268(13:5): 9238-9245 (1993).
Cho et al., "Transcriptional regulation of the fad regulon genes of *Escherichia coli* by ArcA", *Microbiology 152*: 2207-2219 (2006).
Choi et al., "β-Ketoacyl-acyl Carrier Protein Synthase III (FabH) Is a Determining Factor in Branched-Chain Fatty Acid Biosynthesis" *J. of Bacteriology* 182(2): 365-370 (2000).
Collister et al., "Modification of the petroleum system concept: Origins of alkanes and isoprenoids in crude oils" *AAPG Bulletin 88(5)*:587-611 (2004).
Conway et al., "Cloning and Sequencing of the Alcohol Dehydrogenase II Gene from *Zymomonas mobilis*" *J. Bacteriol. 169(6)*: 2591-2597 (1987).
Cropp, et al., "Identification of a Cyclohexylcarbonyl CoA Biosynthetic Gene Cluster and Application in the Production of Doramectin," Nature Biotechnology, vol. 18, Sep. 2000, 4 pages.
da Silva et al., "Comparison of the Genomes of Two *Xanthomonas* Pathogens with Differing Host Specificities" *Nature*, 417: 459-463 (2002).
Database EMBL (Online), Jul. 1996, "*Synechococcus*, PCC7942 Ribosomal Protein S1 of 30S Ribosome (rpsI), ORF271, ORF231, ORF341, Carboxyltransferase alpha subunit (accA), ORF245, ORF227, and GTP cyclohydrolase I (folE) genes, complete cds, and ORF205 gene, partial cds.," XP002564232, 4 pages.
Datsenko, et al., "One-step Inactivation of Chromosomal Genes in *Escherichia coli* K-12 using PCR Products," Proc. Natl. Acad. Sci, USA 97,2000, pp. 6640-6645, 6 pages.
Davis et al., "Inhibition of *Escherichia coli* Acetyl Coenzyme A Carboxylase by Acyl-Acyl Carrier Protein" *J.Bacteriol. 183(4)*: 1499-1503 (2001).

(56) References Cited

OTHER PUBLICATIONS

Dehesh et al., "KAS IV: A 3-ketoacyl-ACP synthase from *Cuphea* sp. Is a medium chain specific condensing enzyme", *The Plant Journal* 15(3):383-390 (1998).

Dehesh et al., "Production of high levels of 8:0 and 10:0 fatty acids in transgenic canola by overexpression of Ch FatB2, a thioesterase cDNA from *Cuphea hookeriana*" *The Plant Journal 9(2)*: 167-172 (1996).

Delay et al., "In Vivo Functional Analyses of the Type II Acyl Carrier Proteins of Fatty Acid Biosynthesis", *J.Biol.Chem.* 282: 20319-20328 (2007).

Demendoza et al., "Thermal Regulation of Membrane Fluidity in *Escherichia coli*. Effects of Overproduction of P-Ketoacylacyl Carrier Protein Synthase 1", *J.Biol.Chem.* 258(4):2098-2101 (1983).

Denoya, et al. "A Second Branded-Chain α-Keto Acid Dehydrogenase Gene Cluster (bkdFGH) from *Streptomyces avermitilis*: Its Relationship to Avermectin Biosynthesis and the Construction of a bkdF Mutant Suitable for the Production of Novel Antiparasitic Avermectins," Journal of Bacteriology, Jun. 1995, pp. 3504-3511, 8 pages.

Deveaux et al., "Genetic and Biochemical Characterization of a Mutation (fatA) That Allows trans Unsaturated Fatty Acids to Replace the Essential cis Unsaturated Fatty Acids of *Escherichia coli*" *J.Bacteriol. 171(3)*:1562-1568 (1989).

Doan et al., "Functional expression of five *Arabidopsis* fatty acyl-CoA reductase genes in *Escherichia coli*" *J. Plant Physiology 166*:787-796 (2009).

Domergue et al., "Acyl Carriers Used as Substrates by the Desaturases and Elongases Involved in Very Long-chain Polyunsaturated Fatty Acids Biosynthesis Reconstituted in Yeast" *J.Biol.Chem 278(37)*:35115-35126 (2003).

Domka et al., "YliH (BssR) and YceP (BssS) Regulate *Escherichia coli* K-12 Biofilm Bormation by Influencing Cell Signaling" *Appl. and Environ. Microbiol.* 72(4):2449-2459 (2006).

Doss, R.P., "Composition and Enzymatic Activity of the Extracellular Matrix Secreted by Germlings of *Botrytis cinerea*," *Appl. and Environ. Microbiol.*, 65(2): 404-408 (1999).

Farewell et al., "Role of the *Escherichia coli* FadR Regulator in Stasis Survival and Growth Phase-Dependent Expression of the uspA, fad, and fab Genes", *J. Bacteriol. 178(22)*: 6443-6450 (1996).

Fehler et al., "Biosynthesis of Hydrocarbons in *Anabaena variabilis*. Incorporation of [*methyl*-$^{14}$C]- and [*methyl*-$^{2}$H$_3$] Methionine into 7- and 8-Methylheptadecances", *Biochemistry 9(2)*: 418-422 (1970).

Feng et al., "A New Member of the *Escherichia coli* fad Regulon: Transcriptional Regulation of fadM (ybaW)", *J. Bacteriol. 191(20)*: 6320-6328 (2009).

Feng et al., "Overlapping Repressor Binding Sites Result in Additive Regulation of *Escherichia coli* FadH by FadR and ArcA" *J. of Bacteriology 192(17)*:4289-4299 (2010).

Feng et al., "*Escherichia coli* Unsaturated Fatty Acid Synthesis: Complex Transcription of the fabA Gene and in Vivo Identification of the Essential Reaction Catalyzed by FabB", *J.Biol.Chem. 284(43)*: 29526-29535 (2009).

Fischer et al., "Selection and optimization of microbial hosts for biofuels production" *Metabolic Engineering 10*:295-304 (2008).

Fleischman et al., Accession No. YP_889972/GI:11849671 (2006).

Fozo et al., "The fabM Gene Product of *Streptococcus mutans* Is Responsible for the Synthesis of Monounsaturated Fatty Acids and Is Necessary for Survival at Low pH", *J. Bacteriol. 186(13)*: 4152-4158 (2004).

Ghisla et al., Acyl-CoA dehydrogenases—A mechanistic overview, *Eur. J. Biochem. 271*: 494-508 (2004).

Hamilton-Kemp et al., "Production of the Long-Chain Alcohols Octanol, Decanol, and Dodecanol by *Escherichia coli*", *Current Microbiology 51*: 82-86 (2005).

Han, et al., "A Novel Alternate Anaplerotic Pathway to the Glyoxylate Cycle in *Streptomycetes*," Journal of Bacteriology, Aug. 1997, pp. 5157-5164, 8 pages.

Han et al., "Biosynthesis of Alkanes in Nostroc Muscorum," Journal of the American Chemical Society, 91:18, Aug. 1969, pp. 5156-5159.

He, et al., "*Nocardia* sp. Carboxylic Acid Reductase: Cloning, Expression, and Characterization of a New Aldehyde Oxidoreductase Family," Applied and Environmental Microbiology, Mar. 2004, pp. 1874-1881, 8 pages.

Heath et al., "Regulation of Malonyl-CoA Metabolism by Acyl-Acyl Carrier Protein and β-Ketoacyl-Acyl Carrier Protein Synthases in *Escherichia coli*", *J.Biol.Chem. 270(26)*:15531-15538 (1995).

Heath et al., "Regulation of Fatty Acid Elongation and Initiation by Acyl-Acyl Carrier Protein in *Escherichia coli*", *J.Biol.Chem. vol. 271(4)*: 1833-1836 (1996).

Heath et al., "Inhibition of β-Ketoacyl-Acyl Carrier Protein Synthase III (FabH) by Acyl-Acyl Carrier Protein in *Escherichia coli*", *J.Biol. Chem.271(18)*:10996-11000 (1996).

Heath et al., "Roles of the FabA and FabZ β-Hydroxyacyl-Acyl Carrier Protein Dehydratases in *Escherichia coli* Fatty Acid Biosynthesis", *J.Biol.Chem. 271(44)*: 27795-27801 (1996).

Heath et al., "Lipid Biosynthesis as a Target for Antibacterial Agents," Progress in Lipid Research 40, 2001, pp. 467-497, 31 pages.

Henry et al., "*Escherichia coli* Transcription Factor That Both Activates Fatty Acid Synthesis and Represses Fatty Acid Degradation", *J. Mol. Biol.* 222: 843-849 (1991).

Hoffmeister, et al., "Mitochondrial trans-2-Enoyl-CoA Reductase of Wax Ester Fermentation from *Euglena gracilis* Defines a New Family of Enzymes Involved in Lipid Synthesis*," The Journal of Biological Chemistry, vol. 280, No. 6, Issue of Feb. 2005, pp. 4329-4338, 10 pages.

Hu et al., Microalgal triacylglycerols as feedstocks for biofuel production: perspectives and advances, *The Plant Journal* 54: 621-639 (2008).

Hunt et al., "Characterization of an Acyl-CoA Thioesterase That Functions as a Major Regulator of Peroxisomal Lipid Metabolism" *J.Biol.Chem. 277(2)*:1128-1138 (2002).

Inui, et al., "Fatty Acid Synthesis in Mitochondria of *Euglena gracilis*," Eur. J. Biochem. 142, 1984, pp. 121-126, 6 pages.

Jarboe, L.R. et al., "Development of Ethanologenic Bacteria," Adv. Biochem. Engin./Biotechnol. 108:237-261 (2007).

Jayakumar et al., "Cloning and expression of the multifunctional human fatty acid synthase and its subdomains in *Escherichia coli*",*PNAS 93*: 14509-14514 (1996).

Jiang et al., "Inhibition of Fatty Acid Synthesis in *Escherichia coli* in the Absence of Phospholipid Synthesis and Release of Inhibition by Thioesterase Action," Journal of Bacteriology, vol. 176, No. 10, May 1994, pp. 2814-2821.

Johnson, et al., "Genetic Analysis of the Role of *Saccharomyces cerebisiae* Acyl-CoA Synthetase Genes in Regulating Protein N-Myristoylation+," The Journal of Biological Chemistry, vol. 269, No. 27, Issue of Jul. 1994, pp. 18037-18046, 10 pages.

Jones et al., "Palmitoyl-Acyl Carrier Protein (ACP) Thioesterase and the Evolutionary-Origin of Plant Acyl-ACP Thioesterases", *Plant Cell*, vol. 7:359-371 (1995).

Juttner et al., "Environmental Factors Affecting the Formation of Mesityloxide, Dimethylallylic Alcohol and Other Volatile Compounds Excreted by *Anabaena cylindrica*," Journal of General Microbiology, 1983, 129, pp. 407-412.

Juttner et al., "The Reducing Capacities of Cyanobateria for Aldehydes and Ketones," Appl. Microbiol. Biotechnol., 1986, 25, pp. 52-54.

Kalscheuer et al., "Microdiesel: *Escherichia coli* Engineered for Fuel Production," Microbiology, 2006, 152, pp. 2529-2536.

Kalscheuer et al., "Neutral Lipid Biosynthesis in Engineered *Escherichia coli*: Jojoba Oil-Like Wax Esters and Fatty Acid Butyl Esters", *Appl.Environ.Microbiol. 72(2)*: 1373-1379 (2006).

Kalscheuer et al., "Analysis of Storage Lipid Accumulation in *Alcanivorax borkumensis*:Evidence for Alternative Triacylglycerol Biosynthesis Routes in Bacteria," J.Bacteriology 189(3): 918-923 (2007).

Kalscheuer et al., "A Novel Bifunctional Wax Ester Synthase/Acyl-CoA:Diacylglycerol Acyltransferase Mediates Wax Ester and Triacylglycerol Biosynthesis in *Acinetobacter alcoaceticus* ADPI," J. Biol. Chem. 278:8075-8082, 2003.

Kameda et al., "Further purification, characterization and salt activation of acyl-CoA synthetase from *Escherichia coli*", *Biochimica et Biophysica Acta 840: 29-36*(1985).

(56) References Cited

OTHER PUBLICATIONS

Keasling et al., "Metabolic engineering delivers next-generation biofuels", *Nature Biotechology* 26(3):298-299 (2008).

Knoll, et al., "Biochemical Studies of Three *Saccharomyces cerevisiae* Acyl-CoA Synthetases, Faa1p, Faa2p, and Faa3p*," The Journal of Biological Chemistry, vol. 269, No. 23, Issue of Jun. 1994, pp. 16348-16356, 9 pages.

Knothe, G. "Dependence of biodiesel fuel properties on the structure of fatty acid alkyl esters," Fuel Processing Technology 86:1059-1070, 2005.

Knudsen et al,. "Transacylation as a chain-termination mechanism in fatty acid synthesis by mammalian fatty acid synthetase. Synthesis of medium-chain-length (C8-C12) acyl-CoA esters by goat mammary-gland fatty acid synthetase", *Biochem. J. 202*: 139-143 (1982).

Koffas, M.A.G., "Expanding the repertoire of biofuel alternatives through metabolic pathway evolution", *PNAS 106(4)*: 965-966 (2009).

Kumari et al., "Regulation of Acetyl Coenzyme A Synthetase in *Escherichia coli*", *J. Bacteriol.* 182(15): 4173-4179 (2000).

Ladygina et al., "A Review of Microbial Synthesis of Hydrocarbons," Process Biochemistry, 41, 2006, pp. 1001-1014.

Lang et al., "Preparation and characterization of bio-diesels from various bio-oils", *Bioresource Tech. 80*: 53-62 (2001).

Lee et al., "Enhanced preference for π-bond containing substrates is correlated to Pro110 in the substrate-binding tunnel of *Escherichia coli* thioesterase I/protease I/lysophospholipase $L_1$" *Biochim. Et Biophys. Acta, 1774*: 959-967 (2007).

Lee et al., "Metabolic engineering of microorganisms for biofuels production: from bugs to synthetic biology to fuels", *Current Opinion in Biotechnology 19*: 556-563 (2008).

Lennen et al., "A Process for Microbial Hydrocarbon Synthesis: Overproduction of Fatty Acids in *Escherichia coli* and Catalytic Conversion to Alkane", *Biotech.Bioengineering 106(2)*:193-202 (2010).

Leonard et al., "A *Cuphea* β-ketoacyl-ACP synthase shifts the synthesis of fatty acids towards shorter chains in *Arabidopsis* seeds expressing *Cuphea* FatB thioesterases", *Plant Journal 13(5)*: 621-628 (1998).

Li et al., "Alteration of the Fatty Acid Profile of *Streptomyces Coelicolor* by Replacement of the Initiation Enzyme 3-Ketoacyl Acyl Carrier Protein Synthase III (FabH)," Journal of Bacteriology, Jun. 2005, pp. 3795-3799, 5 pages.

Li et al., "The Gene Encoding the Biotin Carboxylase Subunit of *Escherichia coli* Acetyl- CoA carboxylase", *J.Biol.Chem. 267(2)*: 855-863 (1992).

Li et al., "The carboxylic acid reduction pathway in *Nocardia*. Purification and characterization of the aldehyde reductase", *J. of Industrial Microbiology & Biotechnology 25*: 328-332 (2000).

Li et al., "Conversion of Fatty Aldehydes to Alka(e)nes and Formate by a Cyanobacterial Aldehyde Decarbonylase: Cryptic Redox by an Unusual Dimetal Oxygenase", *J. Am. Chem. Soc. 133*: 6158-6161 (2011).

Li et al., "Growth Rate Regulation of *Escherichia coli* Acetyl Coenzyme A Carboxylase, Which Catalyzes the First Committed Step of Lipid Biosynthesis", *J. Bacteriol. 175(2)*: 332-340 (1993).

Li et al., "Purification, Characterization, and Properties of an Aryl Aldehyde Oxidoreductase from *Nocardia* Sp. Strain NRRL 5646," Journal of Bacteriology, Jun. 1997, pp. 3482-3487, 6 pages.

Link et al., "Methods for Generating Precise Deletions and Insertions in the Genome of Wild-Type *Escherichia coli*: Application to Open Reading Frame Characterization", *J.Bacteriol. 179(20)*: 6228-6237 (1997).

Liu, et al., "Production and secretion of fatty acids in genetically engineered cyanobacteria" *PNAS Early Edition*: 1-6 (2010).

Lu et al., "Overproduction of free fatty acids in *E. coli*: Implications for biodiesel production", *Metabolic Engineering 10*: 333-339 (2008).

Lykidis et al., "Genomic Prospecting for Microbial Biodiesel Production," NN, Jun. 2008, 41 pages.

Mackey et al., "Detection of Rhythmic Bioluminescence from Luciferase Reporters in Cyanobacteria," Methods in Molecular Biology, Bol. 362, 2007, 16 pages.

Magnuson et al., "Regulation of Fatty Acid Biosynthesis in *Escherichia coli" Microbiol.Reviews 57(3)*: 522-542 (1993).

Marr, et al., "Effect of Temperature on the Composition of Fatty Acids in *Escherichia coli", J.Bacteriol. 84*: 1260-1267 (1962).

Marrakchi, et al., "A New Mechanism for Anaerobic Unsaturated Fatty Acid Formation in *Streptococcus pneumoniae*,*" The Journal of Biological Chemistry, Bol. 277, No. 47, Issue of Nov. 2002, pp. 44809-44816, 6 pages.

Marrakchi, et al., "Mechanistic Diversity and Regulation of Type II Fatty Acid Synthesis," Biochemical Society Transactions, 2002, vol. 30, Part 6, pp. 1050-1055, 6 pages.

Massengo-Tiasse et al., "*Vibrio neumon* FabV Defines a New Class of Enoyl-Acyl Carrier Protein Reductase", *J.Biol.Chem. 283(3)*: 1308-1316 (2008).

Mat-Jan et al., "Mutants of *Esherichia coli* Deficient in the Fermatative Lactate Dehydrogenase," J. Bacteriol. 171(1):342-8 (1989).

Mayer et al., "Identification of amino acid residues involved in substrate specificity of plant acyl-ACP thioesterases using a bioinformatics-guided approach" *BMC Plant Biology 7(1)* (2007).

McCue, L. et al., "hylogenetic footprinting of transcription factor binding sites in proteobacterial genomes," Nucleic Acids Res., 29(3):774-82(2001).

Metz et al., "Purification of a Jojoba Embryo Fatty Acyl-Coenzyme A Reductase and Expression of Its cDNA in High Erucic Acid Rapeseed", *Plant Physiol. 122*: 635-644 (2000).

Metzgar et al., "*Acinetobacter* sp. ADP1: an ideal model organism for genetic analysis and genome engineering", *Nucleic Acid Res. 32(19)*:5780-5790 (2004).

Mohan et al., "An *Escherichia coli* Gene (FabZ) Encoding (3R)-Hydroxymyristoyl Acyl Carrier Protein Dehydrase. Relation to fubA and Suppression of Mutations in Lipid A Biosynthesis", *J.Biol.Chem 269(52)*: 32896-32903 (1994).

Morgan-Kiss et al., "The *Escherichia coli fadK (ydiD)* Gene Encodes an Anaerobically Regulated Short Chain Acyl-CoA Synthetase*," The Journal of Biological Chemistry, vol. 279, No. 36, Sep. 2004, pp. 37324-37333.

Morgan-Kiss et al., "The *Lactococcus lactis* FabF Fatty Acid Synthetic Enzyme can Functionally Replace both the FabB and FabF Proteins of *Escherichia coli* and the FabH Protein of *Lactococcus lactis," Arch. Microbiol. 190*: 427-437 (2008).

Naccarato et al., "In Vivo and In Vitro Biosynthesis of Free Fatty Alcohols in *Escherichia coli* K-12," Lipids, vol. 9, No. 6, 1973, 10 pages.

NCBI Reference, Putative Alcohol Dehydrogenase [*Acinetobacter* sp. ADP1], 2010, retrieved from http://ncbi.nlm.nih.gov/protein/49532534.

NCBI Reference Sequence YP_889972.1, Putative Long-Chain Fatty-Acid-CoA Ligase [Microbacterium Smegmatis Str. MC2 155], retrieved from http://www.ncbi.nlm.nih.gov/protein/118469671, 4 pages.

Nunn et al., "Transport of long-chain fatty acids by *Escherichia coli*: Mapping and characterization of mutants in the fadL gene" *PNAS 75(7)*: 3377-3381 (1978).

Nunn et al., "Role for fadR in Unsaturated Fatty Acid Biosynthesis in *Escherichia coli", J.Bacteriol. 154(2)*:554-560 (1983).

Palaniappan et al., "Enhancement and Selective Production of Phoslactomycin B, a Protein Phosphatase IIa Inhibitor, through Identification and Engineering of the Corresponding Biosynthetic Gene Cluster*," The Journal of Biological Chemistry, vol. 278, No. 37, Issue of Sep. 2003, pp. 35552-35557, 6 pages.

Patton et al., "A Novel $\Delta^3$, $\Delta^2$-Enoyl-CoA Isomerase Involved in the Biosynthesis of the Cyclohexanecarbosylic Acid-Derived Moiety of the Polyketide Ansatrienin A,"Biochemistry 2000, 39, pp. 7595-7604, 10 pages.

Peng et al., "Effect of fadR gene knockout on the metabolism of *Escherichia coli* based on analyses of protein expressions, enzyme activities and intracellular metabolite concentrations" *Enzyme and Microbial Tech. 38*: 512-520 (2006).

(56) References Cited

OTHER PUBLICATIONS

Perez et al., "*Escherichia coli* YqhD Exhibits Aldehyde Reductase Activity and Protects from the Harmful Effect of Lipid Peroxidation-derived Aldehydes" *J.Biol.Chem. 283(12)*: 7346-7353 (2008).

Peterson & Ingram, "Anaerobic Respiration in Engineered *Escherichia coli* with an Internal Electron Acceptor to Produce Fuel Ethanol," Ann. N.Y. Acad. Sci. 1125:363-372 (2008).

Phung et al., "Genes for Fatty Acids Biosynthesis in the Cyanobacterium *Synechococcus* sp. Strain PCC 7942," Jan. 1995, Abstracts of the General Meeting of the American Society of Microbiology, The Society, Washington, DC, p. 524, 1 page.

Pillai et al., "Functional characterization of β-ketoacyl-ACP reductase (FabG) from *Plasmodium falciparum*" Biochem. and Biophysical Research Comm. 303: 387-392 (2003).

Qiu et al., "Crystal structure and substrate specificity of the β-ketoacyl-acyl carrier protein synthase III (FabH) from *Staphylococcus aureus*", Protein Science 14: 2087-2094 (2005).

Rafi et al., "Structure of Acyl Carrier Protein Bound to FabI, the FASII Enoyl Reductase from *Escherichia coli*" *J.Biol.Chem. 281(51)*: 39285-39293 (2006).

Rawlings et al., "The Gene Encoding *Escherichia coli* Acyl Carrier Protein Lies within a Cluster of Fatty Acid Biosynthetic Genes", *J.Biol.Chem. 267(9)*:5751-5754 (1992).

Rawlings et al., "Biosynthesis of fatty acids and related metabolites", *Natural Product Reports 15*: 275-308 (1998).

Ray et al., "Activation of long chain fatty acids with acyl carrier protein: Demonstration of a new enzyme, acyl-acyl carrier protein synthetase, in *Escherichia coli*" PNAS 73(12):4374-4378 (1976).

Rehm et al., "Heterologous expression of the acyl-acyl carrier protein thioesterase gene from the plant *Umbellularia californica* mediates polyhydroxyalkanoate biosynthesis in recombinant *Escherichia coli*", Appl. Microbiol. and Biotech. 55: 205-209 (2001).

Reiser, et al., "Isolation of Mutants of *Acinetobacter calcoaceticus* Deficient in Wax Ester Synthesis of Complementation of One Mutation with a Gene Encoding a Fatty Acylk Coenzyme A Reductase," Journal of Bacteriology, May 1997, pp. 2969-2975, 7 pages.

Rock et al., "Acyl-Acyl Carrier Protein Synthetase from *Escherichia coli*", Meth.Enzymol. 71: 163-168 (1981).

Rock, et al., Increased Unsaturated Fatty Acid Production Associated with a Suppressor of the fabA6(Ts) Mutation in *Escherichia coli*, Journal of Bacterioloy, Sep. 1996, vol. 178, No. 18, pp. 5382-5387, 6 pages.

Rude et al., "Terminal Olefin (1-Alkene) Biosynthesis by a Novel P450 Fatty Acid Decarboxylase from *Jeotgalicoccus* Species", *Appl. Environ.Microbiol. 77(5)*: 1718-1727 (2011).

Rude et al., "New microbial fuels: a biotech perspective", *Current Opinion in Microbiology 12*: 274-281 (2009).

Sabirova et al., "Mutation in a "tesB-Like" Hydroxyacyl-Coenzyme A-Specific Thioesterase Gene Causes Hyperproduction of Extracellular Polyhydroxyalkanoates by *Alcanivorax borkumensis* SK2", *J. Bacteriol. 188(23)*: 8452-8459 (2006).

Saito et al., "Crystal structure of enoyl-acyl carrier protein reductase (FabK) from *Streptococcus neumonia* reveals the binding mode of an inhibitor", Protein Science 17: 691-699 ((2008).

Salas et al., "Characterization of substrate specificity of plant FatA and FatB acyl-ACP thioesterases", *Archives of Biochem. and Biophysics 403*: 25-34 (2002).

Sanchez et al., "Effect of Overexpression of a Soluble Pyridine Nucleotide Transhydrogenase (UdhA) on the Production of Poly(3-hydroxybutyrate) in *Escherichia coli*", *Biotechnol.Prog. 22*: 420-425 (2006).

Schirmer et al., "Microbial Biosynthesis of Alkanes", Science 329:559-562 (2010).

Schujman et al., "A malonyl-CoA-dependent switch in the bacterial response to a dysfunction of lipid metabolism", *Molecular Microbiology, 68(4)*: 987-996 (2008).

Schweizer et al., "Microbial Type I Fatty Acid Synthases (FAS): Major Players in a Network of Cellular FAS Systems", *Microbiol. Mol.Biol.Rev. 68(3)*: 501-517 (2004).

Shockey et al., "*Arabidopsis* Contains Nine Long-Chain Acyl-Coenzyme A Synthetase Genes that Participate in Fatty Acid and Glycerolipid Metabolism," Plant Physiology, Aug. 2002, vol. 129, pp. 1710-1722, 13 pages.

Spencer, et al., "Thioesterases I and II of *Escherichia coli*," The Journal of Biological Chemistry, vol. 253, No. 17, Issue Sep. 1978, pp. 5922-5926, 5 pages.

Stöveken et al., "The Wax Ester Synthase/Acyl Coenzyme A:Diacylglycerol Acyltransferase from *Acinetobacter* sp. Strain ADP1: Characterization of a Novel Type of Acyltransferase", *J. Bacteriology 187(4)*1369-1376 (2005).

Subrahmanyam et al., "Overproduction of a Functional Fatty Acid Biosynthetic Enzyme Blocks Fatty Acid Synthesis in *Escherichia coli*" J.Bacteriology 180(17):4596-4602 (1998).

Sulzenbacher et al., "Crystal Structure of *E. coli* Alcohol Dehydrogenase YqhD: Evidence of a Covalently Modified NADP Coenzyme" *J.Mol.Biol. 342*: 489-502 (2004).

Ta et al., "Cloning, Sequencing, and Overexpression oaf [2Fe-2S] Ferredoxin Gene from *Escherichia coli*", *J.Biol.Chem. 267(16)*:11120-11125 (1992).

Thomason et al., "Identification of the *Escherichia coli* K-12 ybhE Gene as pgl, Encoding 6-Phosphogluconolactonase" *J.Bacteriol. 186(24)*: 8248-8253 (2004).

Thorpe et al., "Structure and mechanism of action of the Acyl-CoA dehydrogenases1", FASEB J. 9: 718-725 (1995).

Tong et al., "Acetyl-Coenzyme A Carboxylases: Versatile Targets for Drug Discovery", *J. Cellular Biochem. 99*: 1476-1488 (2006).

Toomey et al., "Studies on the Mechanism of Fatty Acid Synthesis XVI. Preparation and General Properties of Acyl-Malonyl Acyl Carrier Proteincondensing Enzyme From *Escherichia coli*", *J.Biol. Chem. 241(5)*1159-1165 (1996).

Tsay et al., "Isolation and Characterization of the β-Ketoacyl-acyl Carrier Protein Synthase I11 Gene (fabH) from *Escherichia coli* K-12", *J.Biol.Chem. 267(10)*: 6807-6814 (1992).

Tucci et al., "A Novel Prokaryotic trans-2-enoyl-CoA reductase from the Spirochete *Treponema denticola*," FEBS Letters 581, 2007, pp. 1561-1566, 6 pages.

UniProt accession No. Q325A2 "Subname: Full=Acyl-CoA thioesterase I" (2005).

Vadali et al., "Cofactor engineering of intracellular CoA/acetyl-CoA and its effect on metabolic flux redistribution in *Escherichia coli*" *Metabolic Engineering 6*: 133-139 (2004).

Van Den Berg et al., "The FadL family: unusual transporters for unusual substrates", *Curr.Opin.Struct.Biol. 15*: 401-407 (2005).

Venkitasubramanian et al., "Reduction of Carboxylic Acids by *Nocardia* Aldehyde Oxidoreductase Requires a Phosphopantetheinylated Enzyme*," The Journal of Biological Chemistry, vol. 282, No. 1, pp. 478-485, Jan. 2007, 8 pages.

Voelker et al. "Alteration of the Specificity and Regulation of Fatty Acid Synthesis of *Escherichia coli* by Expression of a Plant Medium-Chain Acyl-Acyl Carrier Protein Thioesterase," *J. Bacteriol., 176(23)*: 7320-7327 (1994).

Wang et al., "Functional Replacement of the FabA and FabB Proteins of *Escherichia coli* Fatty Acid Synthesis by *Enterococcus faecalis* FabZ and FabF Homologues", *J.Biol.Chem.279(33)*: 34489-34495 (2004).

White et al., "Carboxylic acid reductase: a new tungsten enzyme catalyzes the reduction of non-activated carboxylic acids to aldehydes", *Eur. J. Biochem. 184*: 89-96 (1989).

Xu et al., "The FadRzDNA Complex. Transcriptional Control of Fatty Acid Metabolism in *Escherichia coli*", *J.Biol.Chem.276(20)*: 17373-17379, 2001.

Yomano, L.P. et al., "Re-Engineering *Escherichia coli* for ethanol production," Biotechnol. Lett.30:2097-2103 (2008).

Yoo et al., "Determination of the native form of FadD, the *Escherichia coli* fatty acyl-CoA synthetase, and characterization of limited proteolysis by outer membrane protease OmpT", *Biochem. J. 360*: 699-706 (2001).

Yuan-Zheng et al., Metabolic Engineering of *Aeromonas hydrophila* for the Enhanced Production of poly(3-hydroxybutyrate-co-3-hydroxyhexanoate), Appl. Microbiol. Biotechnol., 2006, 69, pp. 537-532.

(56) References Cited

OTHER PUBLICATIONS

Zang et al., "Optimum Conditions for transformation of *Synechocystis* sp. PCC 6803," The Journal of Microbiology, Jun. 2007, vol. 45, No. 3, pp. 241-245.

Zhang et al., "Inhibiting Bacterial Fatty Acid Synthesis", *J.Biol. Chem.* 281(*26*): 17541-17544 (2006).

Zhang et al., "Molecular Effect of FadD on the Regulation and Metabolism of Fatty Acid in *Escherichia coli*," FEMS Microbiol Lett, 259, 2006, pp. 249-253.

Zhang et al., "Structural Basis for Catalytic and Inhibitory Mechanisms of β-Hydroxyacyl-acyl Carrier Protein Dehydratase (FabZ)", *J.Biol.Chem.* 283(*9*):5370-5379 (2008).

Zhang et al., "The FabR (YijC) Transcription Factor Regulates Unsaturated Fatty Acid Biosynthesis in *Escherichia coli*\*," The Journal of Biological Chemistry, vol. 277, No. 18, Issue of May 2002, pp. 15558-15565, 8 pages.

Zheng et al., "Thioesterase II of *Escherichia coli* Plays an Important Role in 3-Hydroxydecanoic Acid Production," Applied and Environmental Microbiology, vol. 70, No. 7, Jul. 2004, pp. 3807-3813, 7 pages.

Zhu et al., "Functions of the *Clostridium acetobutylicium* FabF and FabZ proteins in unsaturated fatty acid biosynthesis", *BMC Microbiology* 9:119 (2009).

Zimhony et al., "Characterization of *Mycobacterium smegmatis* Expressing the *Mycobacterium tuberculosis* Fatty Acid Synthase I (fas1) Gene", *J.Bacteriol.* 186(*13*): 4051-4055 (2004).

International Search Report and Written Opinion from PCT/US2007/011923, mailed Feb. 22, 2008.

Partial International Search Report from the ISA of the EPO from PCT/US2008/058788, mailed May 11, 2008, 4 pages.

International Search Report and Written Opinion of the ISA of the EPO for PCT/US2009/044403, mailed Sep. 25, 2009, 10 pages.

International Search Report and Written Opinion from PCT/US2009/044409, mailed Jan. 29, 2010.

International Search Report and Written Opinion from PCT/US2009/59904, mailed Apr. 5, 2010.

International Search Report and Written Opinion from PCT/US2009/59903, mailed Jun. 2, 2010.

International Search Report and Written Opinion from PCT/US2010/050026, mailed Jan. 6, 2011.

Final Office Action on U.S. Appl. No. 12/575,430, mailed Jun. 7, 2012.

Final Rejection on U.S. Appl. No. 12/575,430, mailed Nov. 29, 2010.

Final Rejection on U.S. Appl. No. 12/575,430, mailed Sep. 1, 2011.

Non-Final Office Action on U.S. Appl. No. 12/575,430, mailed Dec. 27, 2011.

Non-Final Office Action on U.S. Appl. No. 12/575,430, mailed May 13, 2011.

Non-Final Office Action on U.S. Appl. No. 12/575,430, mailed Jun. 10, 2010.

Non-Final Office Action on U.S. Appl. No. 12/575,430, mailed Jul. 7, 2014.

Notice of Allowance on U.S. Appl. No. 12/575,430, mailed Dec. 8, 2014.

\* cited by examiner

FIG. 6A

AAR91681.1

Nucleotide sequence (SEQ ID NO:15)

>gi|40796034:488-4012 Nocardia sp. NRRL 5646 ATP/NADPH-dependent
carboxylic acid reductase (car) gene, complete cds

```
ATGGCAGTGGATTCACCGGATGAGCGGCTACAGCGCCGCATTGCACAGTTGTTTGCAGAAGATGAGCAGG
TCAAGGCCGCACGTCCGCTCGAAGCGGTGAGCGCGGCGGTGAGCGCGCCCGGTATGCGGCTGGCGCAGAT
CGCCGCCACTGTTATGGCGGGTTACGCCGACCGCCCGGCCGCCGGGCAGCGTGCGTTCGAACTGAACACC
GACGACGCGACGGGCCGCACCTCGCTGCGGTTACTTCCCCGATTCGAGACCATCACCTATCGCGAACTGT
GGCAGCGAGTCGGCGAGGTTGCCGCGGCCTGGCATCATGATCCCGAGAACCCCTTGCGCGCAGGTGATTT
CGTCGCCCTGCTCGGCTTCACCAGCATCGACTACGCCACCCTCGACCTGGCCGATATCCACCTCGGCGCG
GTTACCGTGCCGTTGCAGGCCAGCGCGGCGGTGTCCCAGCTGATCGCTATCCTCACCGAGACTTCGCCGC
GGCTGCTCGCCTCGACCCCGGAGCACCTCGATGCGGCGGTCGAGTGCCTACTCGCGGGCACCACACCGGA
ACGACTGGTGGTCTTCGACTACCACCCCGAGGACGACGACCAGCGTGCGGCCTTCGAATCCGCCCGCCGC
CGCCTTGCCGACGCGGGCAGCTTGGTGATCGTCGAAACGCTCGATGCCGTGCGTGCCCGGGGCCGCGACT
TACCGGCCGCGCCACTGTTCGTTCCCGACACCGACGACGACCCGCTGGCCCTGCTGATCTACACCTCCGG
CAGCACCGGAACGCCGAAGGGCGCGATGTACACCAATCGGTTGGCCGCCACGATGTGGCAGGGGAACTCG
ATGCTGCAGGGGAACTCGCAACGGGTCGGGATCAATCTCAACTACATGCCGATGAGCCACATCGCCGGTC
GCATATCGCTGTTCGGCGTGCTCGCTCGCGGTGGCACCGCATACTTCGCGGCCAAGAGCGACATGTCGAC
ACTGTTCGAAGACATCGGCTTGGTACGTCCCACCGAGATCTTCTTCGTCCCGCGCGTGTGCGACATGGTC
TTCCAGCGCTATCAGAGCGAGCTGGACCGGCGCTCGGTGGCGGGCGCCGACCTGGACACGCTCGATCGGG
AAGTGAAAGCCGACCTCCGGCAGAACTACCTCGGTGGGCGCTTCCTGGTGGCGGTCGTCGGCAGCGCGCC
GCTGGCCGCGGAGATGAAGACGTTCATGGAGTCCGTCCTCGATCTGCCACTGCACGACGGGTACGGGTCG
ACCGAGGCGGGCGCAAGCGTGCTGCTCGACAACCAGATCCAGCGGCCGCCGGTGCTCGATTACAAGCTCG
TCGACGTGCCCGAACTGGGTTACTTCCGCACCGACCGGCCGCATCCGCGCGGTGAGCTGTTGTTGAAGGC
GGAGACCACGATTCCGGGCTACTACAAGCGGCCCGAGGTCACCGCGGAGATCTTCGACGAGGACGGCTTC
TACAAGACCGGCGATATCGTGGCCGAGCTCGAGCACGATCGGCTGGTCTATGTCGACCGTCGCAACAATG
TGCTCAAACTGTCGCAGGGCGAGTTCGTGACCGTCGCCCATCTCGAGGCCGTGTTCGCCAGCAGCCCGCT
GATCCGGCAGATCTTCATCTACGGCAGCAGCGAACGTTCCTATCTGCTCGCGGTGATCGTCCCCACCGAC
GACGCGCTGCGCGGCCGCGACACCGCCACCTTGAAATCGGCACTGGCCGAATCGATTCAGCGCATCGCCA
AGGACGCGAACCTGCAGCCCTACGAGATTCCGCGCGATTTCCTGATCGAGACCGAGCCGTTCACCATCGC
CAACGGACTGCTCTCCGGCATCGCGAAGCTGCTGCGCCCCAATCTGAAGGAACGCTACGGCGCTCAGCTG
GAGCAGATGTACACCGATCTCGCGACAGGCCAGGCCGATGAGCTGCTCGCCCTGCGCCGCGAAGCCGCCG
ACCTGCCGGTGCTCGAAACCGTCAGCCGGGCAGCGAAAGCGATGCTCGGCGTCGCCTCCGCCGATATGCG
TCCCGACGCGCACTTCACCGACCTGGGCGGCGATTCCCTTTCCGCGCTGTCGTTCTCGAACCTGCTGCAC
GAGATCTTCGGGGTCGAGGTGCCGGTGGGTGTCGTCGTCAGCCCGGCGAACGAGCTGCGCGATCTGGCGA
ATTACATTGAGGCGGAACGCAACTCGGGCGCGAAGCGTCCCACCTTCACCTCGGTGCACGGCGGCGGTTC
CGAGATCCGCGCCGCCGATCTGACCCTCGACAAGTTCATCGATGCCCGCACCCTGGCCGCCGCCGACAGC
ATTCCGCACGCGCCGGTGCCAGCGCAGACGGTGCTGCTGACCGGCGCGAACGGCTACCTCGGCCGGTTCC
TGTGCCTGGAATGGCTGGAGCGGCTGGACAAGACGGGTGGCACGCTGATCTGCGTCGTGCGCGGTAGTGA
CGCGGCCGCGGCCCGTAAACGGCTGGACTCGGCGTTCGACAGCGGCGATCCCGGCCTGCTCGAGCACTAC
CAGCAACTGGCCGCACGGACCCTGGAAGTCCTCGCCGGTGATATCGGCGACCCGAATCTCGGTCTGGACG
ACGCGACTTGGCAGCGGTTGGCCGAAACCGTCGACCTGATCGTCCATCCCGCCGCGTTGGTCAACCACGT
CCTTCCCTACACCCAGCTGTTCGGCCCCAATGTCGTCGGCACCGCCGAAATCGTCCGGTTGGCGATCACG
GCGCGGCGCAAGCCGGTCACCTACCTGTCGACCGTCGGAGTGGCCGACCAGGTCGACCCGGCGGAGTATC
AGGAGGACAGCGACGTCCGCGAGATGAGCGCGGTGCGCGTCGTGCGCGAGAGTTACGCCAACGGCTACGG
CAACAGCAAGTGGGCGGGGAGGTCCTGCTGCGCGAAGCACACGATCTGTGTGGCTTGCCGGTCGCGGTG
TTCCGTTCGGACATGATCCTGGCGCACAGCCGGTACGCGGGTCAGCTCAACGTCCAGGACGTGTTCACCC
GGCTGATCCTCAGCCTGGTCGCCACCGGCATCGCGCCGTACTCGTTCTACCGAACCGACGCGGACGGCAA
```

FIG. 6B

```
CCGGCAGCGGGCCCACTATGACGGCTTGCCGGCGGACTTCACGGCGGCGGCGATCACCGCGCTCGGCATC
CAAGCCACCGAAGGCTTCCGGACCTACGACGTGCTCAATCCGTACGACGATGGCATCTCCCTCGATGAAT
TCGTCGACTGGCTCGTCGAATCCGGCCACCCGATCCAGCGCATCACCGACTACAGCGACTGGTTCCACCG
TTTCGAGACGGCGATCCGCGCGCTGCCGGAAAAGCAACGCCAGGCCTCGGTGCTGCCGTTGCTGGACGCC
TACCGCAACCCCTGCCCGGCGGTCCGCGGCGCGATACTCCCGGCCAAGGAGTTCCAAGCGGCGGTGCAAA
CAGCCAAAATCGGTCCGGAACAGGACATCCCGCATTTGTCCGCGCCACTGATCGATAAGTACGTCAGCGA
TCTGGAACTGCTTCAGCTGCTCTGA
```

Amino acid sequence (SEQ ID NO:16)

>gi|40796035|gb|AAR91681.1| ATP/NADPH-dependent carboxylic acid
reductase [Nocardia sp. NRRL 5646]

```
MAVDSPDERLQRRIAQLFAEDEQVKAARPLEAVSAAVSAPGMRLAQIAATVMAGYADRPAAGQRAFELNT
DDATGRTSLRLLPRFETITYRELWQRVGEVAAAWHHDPENPLRAGDFVALLGFTSIDYATLDLADIHLGA
VTVPLQASAAVSQLIAILTETSPRLLASTPEHLDAAVECLLAGTTPERLVVFDYHPEDDDQRAAFESARR
RLADAGSLVIVETLDAVRARGRDLPAAPLFVPDTDDDPLALLIYTSGSTGPKGAMYTNRLAATMWQGNS
MLQGNSQRVGINLNYMPMSHIAGRISLFGVLARGGTAYFAAKSDMSTLFEDIGLVRPTEIFFVPRVCDMV
FQRYQSELDRRSVAGADLDTLDREVKADLRQNYLGGRFLVAVGSAPLAAEMKTFMESVLDLPLHDGYGS
TEAGASVLLDNQIQRPPVLDYKLVDVPELGYFRTDRPHPRGELLLKAETTIPGYYKRPEVTAEIFDEDGF
YKTGDIVAELEHDRLVYVDRRNNVLKLSQGEFVTVAHLEAVFASSPLIRQIFIYGSSERSYLLAVIVPTD
DALRGRDTATLKSALAESIQRIAKDANLQPYEIPRDFLIETEPFTIANGLLSGIAKLLRPNLKERYGAQL
EQMYTDLATGQADELLALRREAADLPVLETVSRAAKAMLGVASADMRPDAHFTDLGGDSLSALSFSNLLH
EIFGVEVPVGVVVSPANELRDLANYIEAERNSGAKRPTFTSVHGGGSEIRAADLTLDKFIDARTLAAADS
IPHAPVPAQTVLLTGANGYLGRFLCLEWLERLDKTGGTLICVVRGSDAAAARKRLDSAFDSGDPGLLEHY
QQLAARTLEVLAGDIGDPNLGLDDATWQRLAETVDLIVHPAALVNHVLPYTQLFGPNVVGTAEIVRLAIT
ARRKPVTYLSTVGVADQVDPAEYQEDSDVREMSAVRVVRESYANGYGNSKWAGEVLLREAHDLCGLPVAV
FRSDMILAHSRYAGQLNVQDVFTRLILSLVATGIAPYSFYRTDADGNRQRAHYDGLPADFTAAAITALGI
QATEGFRTYDVLNPYDDGISLDEFVDWLVESGHPIQRITDYSDWFHRFETAIRALPEKQRQASVLPLLDA
YRNPCPAVRGAILPAKEFQAAVQTAKIGPEQDIPHLSAPLIDKYVSDLELLQLL
```

FIG. 7A

Motif 1

-G-Y-X-X-S/A/T-K-W/L (SEQ ID NO:7); and

-G-X-X-G-X-L-G (SEQ ID NO:8); and

-L/V/I-G-G-D-S-X-X-A (SEQ ID NO:9); and

-[LIVMFY]-{E}-{VES}-[STG]-[STAG]-G-[ST]-[STEIA]-[SG]-X-[PASLIVM]-[KR] (SEQ ID NO:10), where {X} stands for any amino acid except X and [$X_1X_2$] stands for $X_1$ or $X_2$ Motif 2

RTVLL$X_1$GA$X_2$G$X_3$LGR$X_4$L$X_5$L$X_6$WL (SEQ ID NO:11)

where $X_1$ is S or T;

$X_2$ is T or N;

$X_3$ is F or W;

$X_4$ is F or Y;

$X_5$ is A or T; and $X_6$ is E or Q

Motif 3

LXXGXXGXLGXXLXLXWLXR (SEQ ID NO:12)

Motif 4

WAXEVLLR (SEQ ID NO:13), where X can be any amino acid; or

LXXGXXGXLGXXLX$X_1$X$X_2$L$X_3$R (SEQ ID NO:14), where $X_1$ is Leu or Ile;

$X_2$ is Trp or Leu; and

FIG. 7B $X_3$ varies between 13 amino acids or 14 amino acids

Motif 5

-G-Y-X-X-S/A/T-K-W/L (SEQ ID NO:7); and

-L/V/I-G-G-D-S-X-X-A (SEQ ID NO:9); and

-[LIVMFY]-{E}-{VES}-[STG]-[STAG]-G-[ST]-[STEIA]-[SG]-X-[PASLIVM]-[KR] (SEQ ID NO:10), where {X} stands for any amino acid except X and [$X_1X_2$] stands for $X_1$ or $X_2$; and RTVLL$X_1$GA$X_2$G$X_3$LGR$X_4$L$X_5$L$X_6$WL (SEQ ID NO:11), where $X_1$ is S or T;

$X_2$ is T or N;

$X_3$ is F or W;

$X_4$ is F or Y;

$X_5$ is A or T; and $X_6$ is E or Q

FIG. 8A

NP 217106 (FADD9)

Nucleotide sequence (SEQ ID NO:17)

>gi|57116681:2917871-2921377 Mycobacterium tuberculosis H37Rv, complete genome

ATGTCGATCAACGATCAGCGACTGACACGCCGCGTCGAGGACCTATACGCCAGCGACGCCCAGTTCGCCG
CCGCCAGTCCCAACGAGGCGATCACCCAGGCGATCGACCAGCCCGGGGTCGCGCTTCCACAGCTCATCCG
TATGGTCATGGAGGGCTACGCCGATCGGCCGGCACTCGGCCAGCGTGCGCTCCGCTTCGTCACCGACCCC
GACAGCGGCCGCACCATGGTCGAGCTACTGCCGCGGTTCGAGACCATCACCTACCGCGAACTGTGGGCCC
GCGCCGGCACATTGGCCACCGCGTTGAGCGCTGAGCCCGCGATCCGGCCGGGCGACCGGGTTTGCGTGCT
GGGCTTCAACAGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACGATGATCGCCA
CCAGCATCGACAATCTTGGCGACGCCGTCGAAGTGCTGGCCGGTCACGCCCCGGCCCGGCTGGTCGTATT
CGATTACCACGGCAAGGTTGACACCCACCGCGAGGCCGTCGAAGCCGCCCGAGCTCGGTTGGCCGGCTCG
GTGACCATCGACACACTTGCCGAACTGATCGAACGCGGCAGGGCGCTGCCGGCCACACCCATTGCCGACA
GCGCCGACGACGCGCTGGCGCTGCTGATTTACACCTCGGGTAGTACCGGCGCACCCAAAGGCGCCATGTA
TCGCGAGAGCCAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACGCTTTCCAACG
GCGGTACCGCCTACTTCGTCGCCAAGAGCGACCTGTCGACGCTGTTCGAGGACCTCGCCCTGGTGCGGCC
CACAGAATTGTGCTTCGTGCCGCGCATCTGGGACATGGTGTTCGCAGAGTTCCACAGCGAGGTCGACCGC
CGCTTGGTGGACGGCGCCGATCGAGCGGCGCTGGAAGCGCAGGTGAAGGCCGAGCTGCGGGAGAACGTGC
TCGGCGGACGGTTTGTCATGGCGCTGACCGGTTCCGCGCCGATCTCCGCTGAGATGACGGCGTGGGTCGA
GTCCCTGCTGGCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGCTACTTCGGCA
CCGATCAGCCCTACCCCGGGGCGAGCTGCTGGTCAAGACGCAAACCATGTTCCCCGGCTACTACCAGCG
CCCGGATGTCACCGCCGAGGTGTTCGACCCCGACGGCTTCTACCGGACCGGGACATCATGGCCAAAGTA
GGCCCCGACCAGTTCGTCTACCTCGACCGCCGCAACAACGTGCTAAAGCTCTCCCAGGGCGAGTTCATCG
CCGTGTCGAAGCTCGAGGCGGTGTTCGGCGACAGCCCGCTGGTCCGACAGATCTTCATCTACGGCAACAG
TGCCCGGGCCTACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCCTACGAGATTC
CACGCGACTTCATCATCGAAACCACGCCGTTCACCCTGGAGAACGGCCTGCTCACCGGCATCCGCAAGCT
GGCACGCCCGCAGTTGAAGAAGTTCTATGGCGAACGTCTCGAGCGGCTCTATACCGAGCTGGCCGATAGC
CAATCCAACGAGCTGCGCGAGCTGCGGCAAAGCGGTCCCGATGCGCCGGTGCTTCCGACGCTGTGCCGTG
CCGCGGCTGCGTTGCTGGGCTCTACCGCTGCGGATGTGCGGCCGGACGCGCACTTCGCCGACCTGGGTGG
TGACTCGCTCTCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGCACCGGCGTCA
GGCGACCCAGCTTCGCCTCGATACACGGTCGCTCCGCGACGGAAGTGCACGCCAGCGACCTCACGCTGGA
CAAGTTCATCGACGCTGCCACCCTGGCCGCAGCCCCGAACCTGCCGGCACCGAGCGCCCAAGTGCGCACC
GTACTGCTGACCGGCGCCACCGGCTTTTTGGGTCGCTACCTGGCGCTGGAATGGCTCGACCGCATGGACC
TGGTCAACGGCAAGCTGATCTGCCTGGTCCGCGCCAGATCCGACGAGGAAGCACAAGCCCGGCTGGACGC
GACGTTCGATAGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTAGCCGACACGG
TGGACCTGATCGTGGACCCCGCGGCCCTGGTCAACCACGTGCTGCCGTATAGCCAGCTGTTCGGCCCAAA
CGCGGCGGGCACCGCCGAGTTGCTTCGGCTGGCGCTGACCGGCAAGCGCAAGCCATACATCTACACCTCG
ACGATCGCCGTGGGCGAGCAGATCCCGCCGGAGGCGTTCACCGAGGACGCCGACATCCGGGCCATCAGCC
CGACCCGCAGGATCGACGACAGCTACGCCAACGGCTACGCGAACAGCAAGTGGGCCGGCGAGGTGCTGCT
GCGCGAAGCTCACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCCGCTACCGGCA
TCGCACCCGGTTCGTTCTATGAGCTGGATGCGCACGGCAATCGGCAACGCGCCCACTATGACGGCTTGCC
GGTCGAATTCGTCGCAGAAGCCATTTGCACCCTTGGGACACATAGCCCGGACCGTTTTGTCACCTACCAC
GTGATGAACCCCTACGACGACGGCATCGGGCTGGACGAGTTCGTCGACTGGCTCAACTCCCCAACTAGCG

FIG. 8B

```
GGTCCGGTTGCACGATCCAGCGGATCGCCGACTACGGCGAGTGGCTGCAGCGGTTCGAGACTTCGCTGCG
TGCCTTGCCGGATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAAATCGGTCCGG
ACAAAGACATTCCGCACCTCACGGCGGCGATCATCGCGAAGTACATCAGCAACCTGCGACTGCTCGGGCT
GCTGTGA
```

Amino acid sequence (SEQ ID NO:18)

>gi|15609727|ref|NP_217106.1| fatty-acid-CoA ligase [Mycobacterium tuberculosis H37Rv]

```
MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLIYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESLQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDVPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV
LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILADT
SYTGQLNLPDMFTRLMLSLAATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALPDRQRHASLLPLLHNYREPAK
PICGSIAPTDQFRAAVQEAKIGPDKDIPHLTAAIIAKYISNLRLLGLL
```

ABK75684 (CARA)

Nucleotide sequence (SEQ ID NO:19)

>gi|118168627:3015785-3019291 Mycobacterium smegmatis str. MC2 155, complete genome

```
TTACAGCAATCCGAGCATCTGCAGGTTGCTGATGTACTTGACGATCACGTCGGCCGTGACGTGCGGAATG
TCCTTGTCGGGGCCGATCTTCGCGTCCTGCACCGCGGCACGGAACCGGTCGGTGGGTGCCATGGCACCGC
ACACGGGCGGTGAGGGCTGCTGATAGTTGTGCAGCAGCGGCAGCAGCGAGGCCTGACGTTGCCGTTCCGG
CAGGGCCCGCAGTGCGGTTTCGAACCGGCTCAGCCAGGTGGCGTAGTCGTCGACGCGGTGCACGGGGTAG
CCGGCCTCGATCAGCCAGTCCACGTACTCGTCGAGGCCGATGCCGTCGTCGTACGGGTTCATCACGTGGA
ACGTCTCGAATCCGTCGGTGACCTGCGAGCCGATGGTGGAGATCGCCTCGGCGATGAACTCCACGGGCAG
CCCGTCGTAGTGGGCGCGCTGCCGGTTGCCGTCCGCATCGAGTTCGTAGAACGAACCGGGCGCGATGCCG
GTCGCCACGAGGCTCAGCATCAGGCGGGTGAACATGTCCGGCAGGTTCAGCTGACCCGAGTAGGTCGTGT
CGGCCAGGATCATGTCGCAGCGGAACACCGAGACCGGCAGACCACACCAGTCGTGCGCCTCCCGCAGCAG
GACCTCGCCGGCCCACTTGCTGTTGCCGTAGCCGTTGGCGTACGAGTCGTCGACCCGGCGCGTCGCGCTG
ATCTCGCGGATGTCGGCGTCCTCGACGAACGCCTCGGGGAGATGCCCTGTCCCACACCGATCGTCGAGA
CGTACACGTACGGCTTGATCGTGGTGGTCAGCGCGATCCGGATGAGTTCGGCGGTGCCGAGCGCATTGGG
TCCGAACATCTGGCTGTACGGCAGGACGTGATTGACCAGGGCGGCCGGATCGACGATCAGATCGACGGTG
TCGGCCAGTCGCTGCCACGTGTCGTGGTCGAGACCCAGATCGGCCTCGCCCTTGTCACCGGCGATCACCT
CGAGGTGATCGGCTGCCAGCGCGCGGTAGTGCTCGAGCAGTGTCGCGTCCCCGGTGTCGAACGTGGCGTC
```

FIG. 8C

```
CAGACGCGCCCGGGCCTCGTCGTCGCTGCGGGCGCGCACCAGGCAGATCACCTTGCCGTCCACCAGGTCC
ATGCGCTCCAGCCATTCCAGCGCCAGATAGCGGCCCAGGAACCCGGTGGCGCCGGTCAGCAGCACGGTGC
GGATCTCGGTGCCCGAACGCGGCAGACCCGGCGCGGCGGACAGGGTCTTGGCGTCGATGAACTTGCCCAG
GGCGAGATCACGCGCGCGCACCTCGGTGGCGTCGCGCCCGTGCACCGACGCGTATGTGGGCGCTTGGAG
CCGCGCAGTTCGCCCTCGATGTAGGCCGCGACGCCTGCCAGGTCGGTGGCCGGGCTGACGATGACGCCGA
CCGGCACGTCGACATCGAAGATCTCGTGCAACAGGTTCGAGAAGCTCAAGGCCGACAACGAATCTCCACC
CAGATCGGTGAAGTGCGCATCGGACCGCAGATCCGTGACGGAGGCACCGAGCAGTGCGACCGCGGCGCGG
CTGACGGTCTCGACCACGGGCCGGTCGGCTCCGTTGCGGCGCAACTCGCGCAACTCGTTGGCCTGCCCCT
CGGCCAGGTCGGTGTAGAGCTGTTCGAGGCGTTCGCCGTAGTGCGCCTTCAGTTTCGGCCGGGCCAGCTT
GCGGATACCGGTCAGCAGGCCGTTCTCCAGCGTGAAAGGTGTTGTCTCGACGAGGAAGTCACGCGGGATC
TCATACGACTGCAATCCGGCGGCTCGTGCCGCGTCCTGCAGTGAGTCGCTGATGCGCGACTTGAGTTCGT
CACCGTCCCAACGTGACAGTGCCTCTTCGGTCGGGACCACGACCGCCAGCAGATAGGACCGCGCGCTGTT
GCCGTAGACGTAGATCTGGCGTACCAGGGGGCTGTCGCCGAACACCGCCTCCAGCTTGGAGACCGTGACG
AATTCGCCCTGCGACAGTTTCAGCACGTTGTTGCGGCGGTCGAGGTATTCGAGATGGTCGGGCCCGAGCT
CGGCGACGATGTCGCCGGTGCGGTAGTACCCGTCCTCGTCGAACATCTCGGCGGTGATCTCCGGACGCTT
GTAGTAGCCGGGGAACATCTGCTCGGACTTGACCAGAAGTTCGCCGCGCGGGTAGGGCCGGTCCGTGGCG
AAGTAGCCGAGATCGGGCACGTCGACCAGCTTGTAGTCGATGACCGGCGGGCGCTGGATCTGCCCGTCGA
TGAACACCGCGCCGGCCTCGGTGGAGCCGTAGCCCTCCAGCAGATGCATGTCGAGCAGGTCCTCGACCCA
GCTCTTCATCTCCGCCGAGATGGGAGCCGATCCGGTCAGGGCCGAAACGAATCGCCCGCCGAGCAGTTGG
GTGCGGACCTCTTCGAGGACTGCGGCTTCGGCTCGGTCCTCGGATCCCTCGGCGCGGCGGTTGTCGAGGC
GGCTCTGGTACTCCTGGAACAGCATGTCCCAGATGCGAGGAACGAAGTTGAGCTGCGTGGGCCGCACGAG
GGCGAGGTCCTCCAGGAAGGTGGACAGGTCGCTGCGTGCGGCGAAGTACGCGGTTCCGCCGCTGGCGAGT
GTGCTGCACAGGATGCCGCGCCCCATGACGTGACTCATGGGCATGAAGTTCAGGGTGATCGACGGCATCA
CGCCGAGGGTCTCGTCCCACCGGGCCTTGGACCCGGCCTGCCACATCGTGGCGGTCTTGGACTCGGGGTA
CATCGCGCCCTTGGGAGTGCCGGTGCTGCCGGAGGTGTAGATGAGAAGGGTCAGCGGGTCGGCCTCGTCG
GGCACGTAGAGCGGTGCGTCGGCGAGTGACCGCCCGCGGTCCAGTGCGTCGGTGATCGTCTCGACGACGA
CGCCGGTGCCTGCGAGCTTGCCCTTGGCCGCCTCGAACGCCTCACGCTGATCGTCGACCTCGTGGCTGTA
GTCGAACACCACCAGTCGCGACGGCGCGGGCCCGGACTCGACGAGAGCGACTGCGTCGGCGAGGAAGTCG
ACGCTCGACGCGATCACCTTGGGCTCGGTCTCGGCGACGATCGGCTGCAGTTGGGCCACCGGCGCACTGG
TCTGCAGCGGTACGGACACGGCGCCGAGTTCGAGCAGGGCGATGTCGATCGTCGTGTAGTCGACACTGGT
GAAACCCAGGATGGCCACGCGGTCACCGGCATTCACCGGATGGTTGTGCCAGGCATTGGTCACGGCCTGG
ATCCGGCCTGCGAGCTGACGGTAGGTGATGGTGTCGAAGCGGGGCAGGAGCTTCGCGGTGGTGCGGCCTT
CTTCGTCGGTGACGAACTCGACGGCGCGCTTGCCCAGCGCAGGGCGGTCCGCATAGCCGGCCAGAATCTG
TTTGACCGCGGCAGGAAGGCGCAACTCCGGATCGGCGGCAGCCGCGCTGATCGCCTCGTCGGGACGGGCG
GCGGCGAACTGCGGGTCGGTTTCGAACAAGTGGTCAATGCGCCGGTTGAAGCGGTCTTCGCGCGTTTCGA
TCGTCAT
```

Amino acid sequence (SEQ ID NO:20)

>gi|118174788|gb|ABK75684.1| NAD dependent epimerase/dehydratase family protein [Mycobacterium smegmatis str. MC2 155]

```
MTIETREDRFNRRIDHLFETDPQFAAARPDEAISAAAADPELRLPAAVKQILAGYADRPALGKRAVEFVT
DEEGRTTAKLLPRFDTITYRQLAGRIQAVTNAWHNHPVNAGDRVAILGFTSVDYTTIDIALLELGAVSVP
LQTSAPVAQLQPIVAETEPKVIASSVDFLADAVALVESGPAPSRLVVFDYSHEVDDQREAFEAAKGKLAG
TGVVVETITDALDRGRSLADAPLYVPDEADPLTLLIYTSGSTGTPKGAMYPESKTATMWQAGSKARWDET
LGVMPSITLNFMPMSHVMGRGILCSTLASGGTAYFAARSDLSTFLEDLALVRPTQLNFVPRIWDMLFQEY
QSRLDNRRAEGSEDRAEAAVLEEVRTQLLGGRFVSALTGSAPISAEMKSWVEDLLDMHLLEGYGSTEAGA
VFIDGQIQRPPVIDYKLVDVPDLGYFATDRPYPRGELLVKSEQMFPGYYKRPEITAEMFDEDGYYRTGDI
VAELGPDHLEYLDRRNNVLKLSQGEFVTVSKLEAVFGDSPLVRQIYVYGNSARSYLLAVVVPTEEALSRW
DGDELKSRISDSLQDAARAAGLQSYEIPRDFLVETTPFTLENGLLTGIRKLARPKLAHYGERLEQLYTD
LAEGQANELRELRRNGADRPVVETVSRAAVALLGASVTDLRSDAHFTDLGGDSLSALSFSNLLHEIFDVD
VPVGVIVSPATDLAGVAAYIEGELRGSKRPTYASVHGRDATEVRARDLALGKFIDAKTLSAAPGLPRSGT
```

FIG. 8D

EIRTVLLTGATGFLGRYLALEWLERMDLVDGKVICLVRARSDDEARARLDATFDTGDATLLEHYRALAAD
HLEVIAGDKGEADLGLDHDTWQRLADTVDLIVDPAALVNHVLPYSQMFGPNALGTAELIRIALTTTIKPY
VYVSTIGVGQGISPEAFVEDADIREISATRRVDDSYANGYGNSKWAGEVLLREAHDWCGLPVSVFRCDMI
LADTTYSGQLNLPDMFTRLMLSLVATGIAPGSFYELDADGNRQRAHYDGLPVEFIAEAISTIGSQVTDGF
ETFHVMNPYDDGIGLDEYVDWLIEAGYPVHRVDDYATWLSRFETALRALPERQRQASLLPLLHNYQQPSP
PVCGAMAPTDRFRAAVQDAKIGPDKDIPHVTADVIVKYISNLQMLGLL

YP 889972 (CARB)

Nucleotide sequence (SEQ ID NO:21)

>gi|118467340:5821317-5824838 Mycobacterium smegmatis str. MC2 155,
complete genome

```
ATGACCAGCGATGTTCACGACGCCACAGACGGCGTCACCGAAACCGCACTCGACGACGAGCAGTCGACCC
GCCGCATCGCCGAGCTGTACGCCACCGATCCCGAGTTCGCCGCCGCCGCACCGTTGCCCGCCGTGGTCGA
CGCGGCGCACAAACCCGGGCTGCGGCTGGCAGAGATCCTGCAGACCCTGTTCACCGGCTACGGTGACCGC
CCGGCGCTGGGATACCGCGCCCGTGAACTGGCCACCGACGAGGGCGGGCGCACCGTGACGCGTCTGCTGC
CGCGGTTCGACACCCTCACCTACGCCCAGGTGTGGTCGCGCGTGCAAGCGGTCGCCGCGGCCCTGCGCCA
CAACTTCGCGCAGCCGATCTACCCCGGCGACGCCGTCGCGACGATCGGTTTCGCGAGTCCCGATTACCTG
ACGCTGGATCTCGTATGCGCCTACCTGGGCCTCGTGAGTGTTCCGCTGCAGCACAACGCACCGGTCAGCC
GGCTCGCCCCGATCCTGGCCGAGGTCGAACCGCGGATCCTCACCGTGAGCGCCGAATACCTCGACCTCGC
AGTCGAATCCGTGCGGGACGTCAACTCGGTGTCGCAGCTCGTGGTGTTCGACCATCACCCCGAGGTCGAC
GACCACCGCGACGCACTGGCCCGCGCGCGTGAACAACTCGCCGGCAAGGGCATCGCCGTCACCACCCTGG
ACGCGATCGCCGACGAGGGCGCCGGGCTGCCGGCCGAACGATCTACACCGCCGACCATGATCAGCGCCT
CGCGATGATCCTGTACACCTCGGGTTCCACCGGCGCACCCAAGGGTGCGATGTACACCGAGGCGATGGTG
GCGCGGCTGTGGACCATGTCGTTCATCACGGGTGACCCCACGCCGGTCATCAACGTCAACTTCATGCCGC
TCAACCACCTGGGCGGGCGCATCCCCATTTCCACCGCCGTGCAGAACGGTGGAACCAGTTACTTCGTACC
GGAATCCGACATGTCCACGCTGTTCGAGGATCTCGCGCTGGTGCGCCCGACCGAACTCGGCCTGGTTCCG
CGCGTCGCCGACATGCTCTACCAGCACCACCTCGCCACCGTCGACCGCCTGGTCACGCAGGGCGCCGACG
AACTGACCGCCGAGAAGCAGGCCGGTGCCGAACTGCGTGAGCAGGTGCTCGGCGGACGCGTGATCACCGG
ATTCGTCAGCACCGCACCGCTGGCCGCGGAGATGAGGGCGTTCCTCGACATCACCCTGGGCGCACACATC
GTCGACGGCTACGGGCTCACCGAGACCGGCGCCGTGACACGCGACGGTGTGATCGTGCGGCCACCGGTGA
TCGACTACAAGCTGATCGACGTTCCCGAACTCGGCTACTTCAGCACCGACAAGCCCTACCCGCGTGGCGA
ACTGCTGGTCAGGTCGCAAACGCTGACTCCCGGGTACTACAAGCGCCCCGAGGTCACCGCGAGCGTCTTC
GACCGGGACGGCTACTACCACACCGGCGACGTCATGGCCGAGACCGCACCCGACCACCTGGTGTACGTGG
ACCGTCGCAACAACGTCCTCAAACTCGCGCAGGGCGAGTTCGTGGCGGTCGCCAACCTGGAGGCGGTGTT
CTCCGGCGCGGCGCTGGTGCGCCAGATCTTCGTGTACGGCAACAGCGAGCGCAGTTTCCTTCTGGCCGTG
GTGGTCCCGACGCCGGAGGCGCTCGAGCAGTACGATCCGGCCGCGCTCAAGGCCGCGCTGGCCGACTCGC
TGCAGCGCACCGCACGCGACGCCGAACTGCAATCCTACGAGGTGCCGGCCGATTTCATCGTCGAGACCGA
GCCGTTCAGCGCCGCCAACGGGCTGCTGTCGGGTGTCGGAAAACTGCTGCGGCCCAACCTCAAAGACCGC
TACGGGCAGCGCCTGGAGCAGATGTACGCCGATATCGCGGCCACGCAGGCCAACCAGTTGCGCGAACTGC
GGCGCGCGGCCGCCACACAACCGGTGATCGACACCCTCACCCAGGCCGCTGCCACGATCCTCGGCACCGG
GAGCGAGGTGGCATCCGACGCCCACTTCACCGACCTGGGCGGGGATTCCCTGTCGGCGCTGACACTTTCG
AACCTGCTGAGCGATTTCTTCGGTTTCGAAGTTCCCGTCGGCACCATCGTGAACCCGGCCACCAACCTCG
CCCAACTCGCCCAGCACATCGAGGCGCAGCGCACCGCGGGTGACCGCAGGCCGAGTTTCACCACCGTGCA
CGGCGCGGACGCCACCGAGATCCGGGCGAGTGAGCTGACCCTGGACAAGTTCATCGACGCCGAAACGCTC
CGGGCCGCACCGGGTCTGCCCAAGGTCACCACCGAGCCACGGACGGTGTTGCTCTCGGGCGCCAACGGCT
GGCTGGGCCGGTTCCTCACGTTGCAGTGGCTGGAACGCCTGGCACCTGTCGGCGGCACCCTCATCACGAT
CGTGCGGGCCGCGACGACCGCGGCCCGCGCACGGCTGACCCAGGCCTACGACACCGATCCCGAGTTG
TCCCGCCGCTTCGCCGAGCTGGCCGACCGCCACCTGCGGGTGGTCGCCGGTGACATCGGCGACCCGAATC
TGGGCCTCACACCCGAGATCTGGCACCGGCTCGCCGCCGAGGTCGACCTGGTGGTGCATCCGGCAGCGCT
GGTCAACCACGTGCTCCCCTACCGGCAGCTGTTCGGCCCCAACGTCGTGGGCACGGCCGAGGTGATCAAG
```

FIG. 8E

```
CTGGCCCTCACCGAACGGATCAAGCCCGTCACGTACCTGTCCACCGTGTCGGTGGCCATGGGGATCCCCG
ACTTCGAGGAGGACGGCGACATCCGGACCGTGAGCCCGGTGCGCCCGCTCGACGGCGGATACGCCAACGG
CTACGGCAACAGCAAGTGGGCCGGCGAGGTGCTGCTGCGGGAGGCCCACGATCTGTGCGGGCTGCCCGTG
GCGACGTTCCGCTCGGACATGATCCTGGCGCATCCGCGCTACCGCGGTCAGGTCAACGTGCCAGACATGT
TCACGCGACTCCTGTTGAGCCTCTTGATCACCGGCGTCGCGCCGCGGTCGTTCTACATCGGAGACGGTGA
GCGCCCGCGGGCGCACTACCCCGGCCTGACGGTCGATTTCGTGGCCGAGGCGGTCACGACGCTCGGCGCG
CAGCAGCGCGAGGGATACGTGTCCTACGACGTGATGAACCCGCACGACGACGGGATCTCCCTGGATGTGT
TCGTGGACTGGCTGATCCGGGCGGGCCATCCGATCGACCGGGTCGACGACTACGACGACTGGGTGCGTCG
GTTCGAGACCGCGTTGACCGCGCTTCCCGAGAAGCGCCGCGCACAGACCGTACTGCCGCTGCTGCACGCG
TTCCGCGCTCCGCAGGCACCGTTGCGCGGCGCACCCGAACCCACGGAGGTGTTCCACGCCGCGGTGCGCA
CCGCGAAGGTGGGCCCGGGAGACATCCCGCACCTCGACGAGGCGCTGATCGACAAGTACATACGCGATCT
GCGTGAGTTCGGTCTGATCTGA
```

Amino acid sequence (SEQ ID NO:22)

>gi|118469671|ref|YP_889972.1| putative long-chain fatty-acid--CoA ligase [Mycobacterium smegmatis str. MC2 155]

```
MTSDVHDATDGVTETALDDEQSTRRIAELYATDPEFAAAAPLPAVVDAAHKPGLRLAEILQTLFTGYGDR
PALGYRARELATDEGGRTVTRLLPRFDTLTYAQVWSRVQAVAAALRHNFAQPIYPGDAVATIGFASPDYL
TLDLVCAYLGLVSVPLQHNAPVSRLAPILAEVEPRILTVSAEYLDLAVESVRDVNSVSQLVVFDHHPEVD
DHRDALARAREQLAGKGIAVTTLDAIADEGAGLPAEPIYTADHDQRLAMILYTSGSTGAPKGAMYTEAMV
ARLWTMSFITGDPTPVINVNFMPLNHLGGRIPISTAVQNGGTSYFVPESDMSTLFEDLALVRPTELGLVP
RVADMLYQHHLATVDRLVTQGADELTAEKQAGAELREQVLGGRVITGFVSTAPLAAEMRAFLDITLGAHI
VDGYGLTETGAVTRDGVIVRPPVIDYKLIDVPELGYFSTDKPYPRGELLVRSQTLTPGYYKRPEVTASVF
DRDGYYHTGDVMAETAPDHLVYVDRRNNVLKLAQGEFVAVANLEAVFSGAALVRQIFVYGNSERSFLLAV
VVPTPEALEQYDPAALKAALADSLQRTARDAELQSYEVPADFIVETEPFSAANGLLSGVGKLLRPNLKDR
YGQRLEQMYADIAATQANQLRELRRAAATQPVIDTLTQAAATILGTGSEVASDAHFTDLGGDSLSALTLS
NLLSDFFGFEVPVGTIVNPATNLAQLAQHIEAQRTAGDRRPSFTTVHGADATEIRASELTLDKFIDAETL
RAAPGLPKVTTEPRTVLLSGANGWLGRFLTLQWLERLAPVGGTLITIVRGRDDAAARARLTQAYDTDPEL
SRRFAELADRHLRVVAGDIGDPNLGLTPEIWHRLAAEVDLVVHPAALVNHVLPYRQLFGPNVVGTAEVIK
LALTERIKPVTYLSTVSVAMGIPDFEEDGDIRTVSPVRPLDGGYANGYGNSKWAGEVLLREAHDLCGLPV
ATFRSDMILAHPRYRGQVNVPDMFTRLLLSLLITGVAPRSFYIGDGERPRAHYPGLTVDFVAEAVTTLGA
QQREGYVSYDVMNPHDDGISLDVFVDWLIRAGHPIDRVDDYDDWVRRFETALTALPEKRRAQTVLPLLHA
FRAPQAPLRGAPEPTEVFHAAVRTAKVGPGDIPHLDEALIDKYIRDLREFGLI
```

YP 905678.1

Nucleotide sequence (SEQ ID NO:23)

>uniprot|A0PPD8|A0PPD8_MYCUA Fatty-acid-CoA ligase FadD9

```
ATGTCGCCAATCACGCGTGAAGAGCGGCTCGAGCGCCGCATCCAGGACCTCTACGCCAAC
GACCCGCAGTTCGCCGCCGCCAAACCCGTCACGGCGATCACCGCAGCAATCGAGCGGCCG
GGTCTACCGCTACCCCAGATCATCGAGACCGTCATGACCGGATACGCCGATCGGCCGGCT
CTCGCTCAGCGCTCGGTCGAATTCGTGACCGATGCCGGCACCGGCCACACCACGCTGCGA
CTGCTCCCCCACTTCGAAACCATCAGCTACGGCGAGCTTTGGGACCGCATCAGCGCACTG
GCCGACGTGCTCAGCACCGAACAGACGGTGAAACCGAGCGACCGGGTCTGCTTGTTGGGC
TTCAACAGCGTCGACTACGCCACGATCGACATGACTTTGGCGCGGCTGGGCGCGGTGGCT
GTACCACTGCAGACCAGCGCGGCGATAACCCAGCTGCAGCCGATCGTCGCCGAGACCCAG
CCCACCATGATCGCGGCCAGCGTCGACGCACTCGCTGACGCCACCGAATTGGCTCTGTCC
```

FIG. 8F

```
GGTCAGACCGCTACCCGAGTCCTGGTGTTCGACCACCACCGGCAGGTTGACGCACACCGC
GCAGCGGTCGAATCCGCCCGGGAGCGCCTGGCTGGCTCGGCGGTCGTCGAAACCCTGGCC
GAGGCCATCGCGCGCGGCGACGTGCCCCGCGGTGCGTCCGCCGGCTCGGCGCCCGGCACC
GATGTGTCCGACGACTCGCTCGCGCTACTGATCTACACCTCGGGCAGCACCGGTGCGCCC
AAGGGCGCGATGTACCCCCGACGCAACGTTGCGACCTTCTGGCGCAAGCGCACCTGGTTC
GAAGGCGGCTACGAGCCGTCGATCACGCTGAACTTCATGCCAATGAGCCACGTCATGGGC
CGCCAAATCCTGTACGGCACGCTGTGCAATGGCGGCACCGCCTACTTCGTGGTGAAAAGC
GATCTCTCCACCTTGTTCGAAGACCTGGCGCTGGTGCGGCCCACCGAGCTGACCTTCGTG
CCGCGCGTGTGGGACATGGTGTTCGACGAGTTTCAGAGTGAGGTCGACCGCCGCCTGGTC
GACGGCGCCGACCGGGTCGCGCTCGAAGCCCAGGTCAAGGCCGAGATACGAACGACGTG
CTCGGTGGACGGTATACCAGCGCACTGACCGGCTCCGCCCCGATCTCCGACGAGATGAAG
GCGTGGGTCGAGGAGCTGCTCGACATGCATCTGGTCGAGGGCTACGGCTCCACCGAGGCC
GGGATGATCCTGATCGACGGAGCCATTCGGCGCCCGGCGGTACTCGACTACAAGCTGGTC
GATGTTCCCGACCTGGGTTACTTCCTGACCGACCGGCCACATCCGCGGGGCGAGTTGCTG
GTCAAGACCGATAGTTTGTTCCCGGGCTACTACCAGCGAGCCGAAGTCACCGCCGACGTG
TTCGATGCTGACGGCTTCTACCGGACCGGCGACATCATGGCCGAGGTCGGCCCCGAACAG
TTCGTGTACCTCGACCGCCGCAACAACGTGTTGAAGCTGTCGCAGGGCGAGTTCGTCACC
GTCTCCAAACTCGAAGCGGTGTTTGGCGACAGCCCACTGGTACGGCAGATCTACATCTAC
GGCAACAGCGCCCGTGCCTACCTGTTGGCGGTGATCGTCCCCACCCAGGAGGCGCTGGAC
GCCGTGCCTGTCGAGGAGCTCAAGGCGCGGCTGGGCGACTCGCTGCAAGAGGTCGCAAAG
GCCGCCGGCCTGCAGTCCTACGAGATCCCGCGCGACTTCATCATCGAAACAACACCATGG
ACGCTGCAGAACGGCCTGCTCACCGGCATCCGCAAGTTGGCCAGGCCGCAGCTGAAAAAG
CATTACGGCGAGCTTCTCGAGCAGATCTACACGGACCTGGCACACGGCCAGGCCGACGAA
CTGCGCTCGCTGCGCCAAAGCGGTGCCGATGCGCCGGTGCTGGTGACGGTGTGCCGCGCG
GCGGCCGCGCTGTTGGGCGGCAGCGCCTCTGACGTCCAGCCCGATGCGCACTTCACCGAT
TTGGGCGGCGACTCGCTGTCGGCGCTGTCGTTCACCAACCTGCTGCACGAGATCTTCGAC
ATCGATGTGCCGGTGGGCGTCATCGTCAGCCCCGCCAACGACTTGCAGGCCCTGGCCGAC
TACGTCGAGGCGGCTCGCAAACCCGGCTCGTCACGACCGACCTTCGCCTCGGTCCACGGC
GCCTCGAATGAGCAGGTCACCGAGGTGCATGCCGGTGACCTGTCCCTGGACAAATTCATC
GATGCCGCAACCCTGGCCGAAGCTCCCCGGCTGCCCGCCGCAAACACCCAAGTGCGCACC
GTGCTGCTGACCGGCGCCACCGGCTTCCTCGGGCGCTACCTGGCCCTGGAATGGCTGGAG
CGGATGGACCTGGTCGACGGCAAACTGATCTGCCTGGTCCGGGCCAAGTCCGACACCGAA
GCACGGGCGCGGCTGGAAAAGACGTTCGACAGCGGCGCCCCCGAACTGCTGGCCCACTAC
CGCGCACTGGCCGGCGACCACCTCGAGGTGCTCGCCGGTGACAAGGGCGAAGCCGACCTC
GGACTGGACCGGCAGACCTGGCAACGCCTGGCCGACACGGTCGACCTGATCGTGGACCCC
GCGGCCCTGGTCAACCACGTACTGCCATACAGCCAGCTGTTCGGGCCCAACGCGCTGGGC
ACCGCCGAGCTGCTGCGGCTCGCGCTCACCTCCAAGATCAAGCCCTACAGCTACACCTCG
ACAATCGGTGTCGCCGACCAGATCCCGCCGTCGGCGTTCACCGAGGACGCCGACATCCGG
GTCATCAGCGCCACCCGCGCGGTCGACGACAGCTACGCCAATGGCTATTCGAACAGCAAG
TGGGCCGGCGAGGTGCTGTTGCGCGAGGCGCATGTCCTGTGTGGCCTGCCGGTTGCGGTG
TTCCGCTGCGACATGATCCTGGCCGACACCACATGGGCGGGACAGCTCAACGTGCCGGAC
ATGTTCACCCGTATGATCCTGAGCCTGGCGGCCACCGGTATCGCGCCGGGTTCGTTCTAT
GAGCTTGCGGCCGACGGCGCCCGGCAACGCGCCCACTATGACGGTCTGCCCGTCGAGTTC
ATCGCCGAGGCGATTTCGACTTTGGGTGCGCAGAGCCAGGATGGGTTCCACACGTATCAC
GTGATGAACCCTTACGACGACGGCATCGGACTCGACGAGTTCGTCGACTGGCTCAACGAG
TCCGGTTGCCCCATCCAGCGCATCGCTGACTATGGCGACTGGCTGCAGCGCTTCGAAACC
GCACTGCGCGCACTGCCCGATCGGCAGCGGCACAGCTCACTGCTGCCGCTGTTGCACAAC
TATCGGCAGCCGGAGCGGCCCGTCCGCGGGTCGATCGCCCCTACCGATCGCTTCCGGGCA
GCGGTGCAAGAGGCCAAGATCGGCCCCGACAAAGACATTCCGCACGTCGGCGCGCCGATC
ATCGTGAAGTACGTCAGCGACCTGCGCCTACTCGGCCTGCTCTGA
```

FIG. 8G

Amino acid sequence (SEQ ID NO:24)

>uniprot|A0PPD8|A0PPD8_MYCUA Fatty-acid-CoA ligase FadD9

MSPITREERLERRIQDLYANDPQFAAAKPVTAITAAIERPGLPLPQIIET
VMTGYADRPALAQRSVEFVTDAGTGHTTLRLLPHFETISYGELWDRISAL
ADVLSTEQTVKPSDRVCLLGFNSVDYATIDMTLARLGAVAVPLQTSAAIT
QLQPIVAETQPTMIAASVDALADATELALSGQTATRVLVFDHHRQVDAHR
AAVESARERLAGSAVVETLAEAIARGDVPRGASAGSAPGTDVSDDSLALL
IYTSGSTGAPKGAMYPRRNVATFWRKRTWFEGGYEPSITLNFMPMSHVMG
RQILYGTLCNGGTAYFVVKSDLSTLFEDLALVRPTELTFVPRVWDMVFDE
FQSEVDRRLVDGADRVALEAQVKAEIRNDVLGGRYTSALTGSAPISDEMK
AWVEELLDMHLVEGYGSTEAGMILIDGAIRRPAVLDYKLVDVPDLGYFLT
DRPHPRGELLVKTDSLFPGYYQRAEVTADVFDADGFYRTGDIMAEVGPEQ
FVYLDRRNNVLKLSQGEFVTVSKLEAVFGDSPLVRQIYIYGNSARAYLLA
VIVPTQEALDAVPVEELKARLGDSLQEVAKAAGLQSYEIPRDFIIETTPW
TLQNGLLTGIRKLARPQLKKHYGELLEQIYTDLAHGQADELRSLRQSGAD
APVLVTVCRAAAALLGGSASDVQPDAHFTDLGGDSLSALSFTNLLHEIFD
IDVPVGVIVSPANDLQALADYVEAARKPGSSRPTFASVHGASNEQVTEVH
AGDLSLDKFIDAATLAEAPRLPAANTQVRTVLLTGATGFLGRYLALEWLE
RMDLVDGKLICLVRAKSDTEARARLEKTFDSGAPELLAHYRALAGDHLEV
LAGDKGEADLGLDRQTWQRLADTVDLIVDPAALVNHVLPYSQLFGPNALG
TAELLRLALTSKIKPYSYTSTIGVADQIPPSAFTEDADIRVISATRAVDD
SYANGYSNSKWAGEVLLREAHVLCGLPVAVFRCDMILADTTWAGQLNVPD
MFTRMILSLAATGIAPGSFYELAADGARQRAHYDGLPVEFIAEAISTLGA
QSQDGFHTYHVMNPYDDGIGLDEFVDWLNESGCPIQRIADYGDWLQRFET
ALRALPDRQRHSSLLPLLHNYRQPERPVRGSIAPTDRFRAAVQEAKIGPD
KDIPHVGAPIIVKYVSDLRLLGLL

ZP_04027864

Nucleotide sequence (SEQ ID NO:25)

>gi|227980074:564806-568123 Tsukamurella paurometabola DSM 20162
TpauDRAFT_4083016_Cont3, whole genome shotgun sequence ATGTCGATTGAGACGGTGCAGAACGGCGTCCCCGCAGAGGGCTCGGTGCCCCCGCCGACCAGCAGACCGA
GCGACTGCCGCAGGTGATCGCCAGGATCTTCGCCCAGTTCGCGGATCGTCCGGCCTTCGCGACCCGCGAGG
CGGGGCCGGGGACCCCCTACGCCACCGTCTCCTATCGGGAGATCTGGCGGCGCGTCACCGCGCTGGTGGCC
TCCTGGCAGAGCGAAGTGGCTCCGGGAGACTTCGTCGCCATCCTCGGCTTCACCAGCTCGGACTTCGTGAC
CGTCGACCTCGCGACCACACTGCTCGGCGCCCCGAACGTGCCGCTCCAGGCCGGGGCCCCCGCCGCTCGCA
TCGCGACCATCCTCGATGAGACCCGGCCGAAGATCCTCGCCGTGAGTGCCGATCAGGTCGACCTCGCCCAG
GAGGCTCTGGCCGAGTCCGCGGCTACCCCGCGGGTGGTCGTCTTCGACGGCGAACGCGACGGCTACGAGGG
CATCGAGGCGGACATCCTTTCCGGCTCCGCCCTGCCGGCACCGGAGTTCTTCGCGCCCGAGCCCGGCACCG
ATCCTCTCGTCACGCTCATCTACACATCCGGCAGCACCGGTACCCCGAAGGGGGCCATGTACACCGAGCAG
TTGGTTCGCGATGCCTGGCTCAAGGTGGACAGCATCGTCGACATCGACATGCCGGCCGAGTCGCTCCTGCA
CTTCCTGCCTATGAGCCATATGTACGGGCGCAACTGGCTGATCGCCGGCCTGGCATCGGGCGGGACCGGGT
ACTTCGCCGGCGCCTCCGATATGTCCACCCTGTTCGACGACCTCGCCGCCGCCCGGCCCACCGCCATCGGC
CTGGTGCCCCGCGTGTGCGAGCTGATACACCAGCGCTATCTGGCCGTCGAGGCGGACACTGATGCGGAGAC
CGCGCGCGTCGAACTGCGTGACCGGGTACTCGGCGGTCGGCTGCAGGCCGCGATGTGCGGTAGCGCCGCCC
TCTCGTCGGAGCTGCAGACCTTCATGGAGTGGTTGCTCGGAATCGATATCCAGATCGGCTACGGATCCACC

FIG. 8H

```
GAGGCCGGTGGTGTCATCCGCGACGGAGTGGTCGTTCGGCCGCCGGTCACGGAGTACAAGCTGATCGATGT
CCCCGAACTGGGCTACTTCGTCACCGACTCCCCGCATCCACGCGGCGAACTCCTGGTCAAGTCGACGCAGT
TGATTCCCGGGTACTACAACTCCGACAAGCGGATCCGCGACGACGAAGGCTTCTACCGCACCGGCGATGTG
ATGGCCGAGCTGGGACCCGACCGGCTCGAGTACGTCGACCGGCGGAGCAACGTGATCAAGTTGGCACAGGG
AGAGTTCGTGCCGATCGCCCAACTCGAGGCCATCTACGCCGCCGGTCCCGATGTGCACCAGATCTTCCTGT
ACGGAACCAGCGAACGCTCCTACCTGATCGGCGTCGTCGTGCCCGCGCCGGGACCCGACGGCGAGACCGAT
GCGCAGACCCGCACCCGCGTACTCGATGGCCTGGCCGCGATCGCCCGTGAGAACGATCTCGCTGCCTACGA
GGTGCCGCGCGATGTGCTCATCGAACGTGATCCCTTCTCTCAGGAGAACGGGCTGCGGTCGGGGATCGGCA
AGCTGGTGCGCCCGGCCCTCATCGCCCGCTACGGTGACCGGTTGCACGACCTCTACGCCCAGGCCGACACC
CGTCAACGCGAGGGCTTGCGCGCTCTCGACGCCTCGGGCCCGATCATCGACACCGTGCTCGGGGCGGCTGC
GTTGACGCTCGGCGCGGATATCGCGGACTTCGACGCCGACACTCGATTCGGCGACCTCGGTGGCGACTCGT
TGTCGGCGCTCTCGCTCGCGACGACGCTCGAAGGCCTCTACGACGTGCCCGTCCCCGTGCAGACGATCGTC
GGACCGACCGCCACACTCGGCGGCGTCGCCCGGCACATCGAGAAGGCTCGATCGGGTGGCGTCGCGGCACC
GACCGCCGACTCGGTGCACGGCGTGGGTGCGAGCGTCGCCCGGGCCACCGACCTGACGCTGGAGAAGTTCA
TCGACCCCGAGCTCCTCGCGCTCGCGCCGACGCTTCCCGCGGCGACCGGTGAGCCGAACACCGTGCTGCTC
ACCGGATCCACCGGCTACCTCGGCCGCTTCCTGCTGCTGGACTGGTTGCGACGGGTCGCTCCGCACGGCGG
CACCGTGATCGCGCTGGTGCGCGGCGCCGACGCCGACGATGCGCGACGCCGCGTCACGGCCGCGATCGGTG
ACTCGGATCCTGACCTGACACAAGAGTTCACGTCACTCGCGGAGCATCACCTCCACGTGATCGCCGGTGAC
TTCGGCAGCCCCGCACTCGGACTCGACGATGCCACCTGGAGCGATCTCGCCGGGCGAGTCGATCACGTGGT
GCACTGCGGCGCGCTCGTCAACCACGTGCTGCCCTACGACCAACTGTTCGGTCCCAATGTGGTGGCCACCG
GCGAAGTGGTGCGACTCGCACTCACCACGCGCCGCAAGTCCGTGGATTACGTCTCCACGGTGGCTGTGGTT
CCGCAGGATGACGGCCGCGTCCTGGTCGAGGACGACGATGTTCGCGAGCTCGGCGCCGAACGGCGCATCGG
GGCCGATGCCTACGCGAACGGCTACGCCGTGAGCAAATGGGCGGGCGAAGTGCTGTTGCATGAGGCAGCCG
ACCTGGCGGACCTGCCGGTGCGGGTGTTCCGCTCCGATATGATCTTGGCGCACAGTCGATTCCACGGACAG
TTCAACGAGGTCGACCAGTTCACCCGCCTGCTCCTGAGTATCGCCGAGACCGGACTGGCGCCGGCGTCGTT
CTACACGCCGGATCCGAGTGGACACCGCCCGCACTACGACGGGCTGCCGGTGGACTTCACCGCCGAAGCGA
TCACCACGCTCAGCGCCGCGGGGCGTTCGGGGTACCGGACCTTCCACGTGCTCAACGCCAACGATGACGGC
GTGAGCCTGGACAGCTTCGTCGACTGGATCGCCGCCTCGGGCCGGAGCATCGAACGGATCGACGACTACGA
CACCTGGTTCGCCCGGTTCGAGCAGGCGCTCCAGCAGCTCCCCGATGAGGCGCGCCAGCGGTCGGTGCTGC
CCCTGCTGCACGCGGTGCGCGAGCCGGCTCCGGCCGCCGGGACCTCCGCGCTGTCGGTGGACCGGTTCCGT
GGTGCGGTGCGTGAGACCGGAGTAGGACCGGGGGACATCCCGGTGCTCGATCGCGCCCTGATCGAGAAGTA
CCTGCGCGACTTCGAGACCGCGGGCTGGCTCGCGCCCGGTGCGCGCGACTGA
```

Amino acid sequence (SEQ ID NO:26)

>gi|227980601|ref|ZP_04027864.1| thioester reductase-like protein
[Tsukamurella paurometabola DSM 20162]

MSIETVQNGVPAEGSVPPADQQTERLPQVIARIFAQFADRPAFATREAGPGTPYATVSYREIWRRVTALV
ASWQSEVAPGDFVAILGFTSSDFVTVDLATTLLGAPNVPLQAGAPAARIATILDETRPKILAVSADQVDL
AQEALAESAATPRVVVFDGERDGYEGIEADILSGSALPAPEFFAPEPGTDPLVTLIYTSGSTGTPKGAMY
TEQLVRDAWLKVDSIVDIDMPAESLLHFLPMSHMYGRNWLIAGLASGGTGYFAGASDMSTLFDDLAAARP
TAIGLVPRVCELIHQRYLAVEADTDAETARVELRDRVLGGRLQAAMCGSAALSSELQTFMEWLLGIDIQI
GYGSTEAGGVIRDGVVVRPPVTEYKLIDVPELGYFVTDSPHPRGELLVKSTQLIPGYYNSDKRIRDDEGF
YRTGDVMAELGPDRLEYVDRRSNVIKLAQGEFVPIAQLEAIYAAGPDVHQIFLYGTSERSYLIGVVVPAP
GPDGETDAQTRTRVLDGLAAIARENDLAAYEVPRDVLIERDPFSQENGLRSGIGKLVRPALIARYGDRLH
DLYAQADTRQREGLRALDASGPIIDTVLGAAALTLGADIADFDADTRFGDLGGDSLSALSLATTLEGLYD
VPVPVQTIVGPTATLGGVARHIEKARSGGVAAPTADSVHGVGASVARATDLTLEKFIDPELLALAPTLPA
ATGEPNTVLLTGSTGYLGRFLLLDWLRRVAPHGGTVIALVRGADADDARRRVTAAIGDSDPDLTQEFTSL
AEHHLHVIAGDFGSPALGLDDATWSDLAGRVDHVVHCGALVNHVLPYDQLFGPNVVATGEVVRLALTTRR

FIG. 8I

KSVDYVSTVAVVPQDDGRVLVEDDDVRELGAERRIGADAYANGYAVSKWAGEVLLHEAADLADLPVRVFR
SDMILAHSRFHGQFNEVDQFTRLLLSIAETGLAPASFYTPDPSGHRPHYDGLPVDFTAEAITTLSAAGRS
GYRTFHVLNANDDGVSLDSFVDWIAASGRSIERIDDYDTWFARFEQALQQLPDEARQRSVLPLLHAVREP
APAAGTSALSVDRFRGAVRETGVGPGDIPVLDRALIEKYLRDFETAGWLAPGARD

ZP_05045132

Nucleotide sequence (SEQ ID NO:27)

>gi|254430111:343253-346687 Cyanobium sp. PCC 7001 scf_1106012173546
genomic scaffold, whole genome shotgun sequence GTGAATGAGTCTTCCGCGGACCAGAGTTCCGGCAACGTTTCCGAGGGGTGGCCTGATGCTTCGGTCACAGC
ACGGGCCCTGCAGGCTCACCTGCGCTACGAACAGATCATCGATGCCATTCTGAGCGGCTACGCCGAGCGCC
CTGCTCTGGCGGAGCGTTCCTACCTGGTGCGGCCGGACCCGAGCACAGGTCAAACGGTGCGTGTCCACGAG
CAGGCCTTCCGCTCGATCAGCTACCGAACCCTGCAGGAACGGGTTCATGCCCTCACCATGGCCTGGCGCCT
TCATCCCGATAGCCCGGTGCAAGCGGGAGCCTTCGTGGTGCTGGTGGGATTTGCCAGCATCGATTACGCCG
TTCTTGATCTGGCACTGGCCTACACCAAGGGCGTGCCGGTGCCCCTGTCACCGAACCATTCCAGCGAGGAC
GATGACGCCATCCTCGGCACAGTCCAGCCCGTCACTCTGGCGGTATCGATCAGTGAGTTCTCTGGCTGTGT
CGACCTGATCGCCCGATCGACGTCGATCCGAACTGTGATCGTCTTTGACCTTGACCCTGCCGTCGACTGCG
AGCGCGCCGCACTGGAGAGCGGCATCCGGGCACTCAACGAGAAGGGGTCAGACGTTGTCGTTCAGACACTG
CAGGATCTGATTGACGTTGGGAGAGACGCAGAGTTCAGCTTCCTGCCGATCCAGGCGCAGGATCAAGATGA
CCTGGCACTTCTGATTCACACATCCGGCAGCACAGGCACACCCAAGGGAGCCTGCATCTCATCCCGTGCAC
TGATCAACACCTGGCGCCATGTTTCCGGTCCCTATCCAAAAGTGACCGTGGTTCTGGCACCCTTCCACCAC
ATGATGGGACGAGACTCGATGATCACGGCATTGGGCGCGGGCGGCACCGCCTACTTCACGCTCAGGCCTGA
CCTTTCGACCGTGATTGAAGACATCAGACTGGCACGGCCCACAGGCCTGGTGCTGTTTCCCCGCCTCTGCG
AAGTGATCGAACACCACCTGACTACTGCGCCGGAGTATTCAGGCAACGAGATCCTCGGAGGCAGACTGCAA
TCCATTGTGGTGGCCTCGGCTCCGATCACGCCACGCTTGAAGGCATCCCTGGAGTGCCTCCTTGGGGTGCC
TGTGAGCGAAGGCTACAGCAGCACGGAAACAGCCAGTGGCGGGCTGGCGATGAATGGACTGCTGAACCGCA
ACAACATTCTCGCGTATCGCCTTCGCGATGTGCCCGAGGCAGGGTATTCAGTGAATGATCGGCCCTTTCCG
CGCGGAGAACTCTGCGTGAAGACCCGCTTCGGTATCTCAGGCTATTTCAGAAATCCAGAGGCCACTGCAGA
GCTGTTCGACGACGATGGCTTCTATTGCACCGGTGACATCGTTGAAGAGCGGGCCCCCGATCAAATCGCCA
TCATCGACCGGCGAAAGAATGTCATCAAGCTGGCGCAGGGTGAATATGTCGCTGTGGGCAGGCTGGAACAG
CTTTTCCAGGAAGGTTGTGGTTGCGTGCAGCAGATTCACCTCCACGGCGACAGCACAAGGGCCTATCTGCT
GGCAGTCGTGGTACCTGATCGCAACACCCTTGCACCGCCCGGGTCACGGCAGGCCAGTGAGGCCGAGTTAA
AGGCACGGGTGCGCGAGGAGATTCTCACCTTGGCAAACCAACGGGAGCTGCGCGGCTTCGAGATCCCTCGA
GACCTGATCCTGGCGGAGGAACCCTTCTCCCAGCAGAACGGTCTGCTGTCGTCCTTGGGTAAGCCGATCCG
CCCGGCCATCCGCGCGCGCTACCGCAGCCGGCTGGAGAGCCTGTATGCCAGCCATGAGGCCACCCGAGGCA
CTGAGCTCGAGGCCATCAGAGCGTCAGCTGGCGCGGTGGATGTGGAAACCACCCTGTTGGCGCTGCTGAGC
AGCACGCTGGGTGTGGTGTGTGGGGCTGCCGATCGGCAGACGAGTTTCCGCGAGCTGGGGGGCGACTCCCT
GGCCGCTGTGCAGCTGGCGATGGAGATCAAGAAGCAGTTCGGGGTGGGGCTGGAAGGGAGCCAGATTCTCG
GGCCGGGCGGCACGGTGGAAGCGTGGGCGCGGAGGATCCACACCGCCTCCATCCAGCAGGCCCCGCACCAG
CGGGTTGGCAGTCCCCTCGCCGCCATTCCGGCCGAGGGGTGGCTGAAGCCGGACCACTACAGGCTGGAGAA
CCTGATCGGGATTCCCATCGGTACACCCTCAGCCGAGGTGGCCAGGCCCACAGGCGGGCCCCCTACGGTTC
TGCTCACCGGTGCCACCGGTTTTCTGGGGGGCGCTTGTGCCTGGAGTGGCTGCAACGGCTGGCTGGCCAG
GGGGCAGGCTGATCTGTCTGGTGCGCCCCTCGAACAGCCATTCCGCCTGGGAGCGACTGAGGAACCGCTT
CTCCCATCTGGAACCCGAGCAGGTGGCACGCTTCCGCGAGCTGGCGGGAAGGCATCTGGAGGTGATTCCGG
CGGACATCGGAGAGCCCGGCCTGGGCTTGAACCGGGTTGCCAGGAGCGGCTCGCCACTGAGGTGGACGCG
ATCTGTCACTGCGCAGCGGAAGTGAATCACCGGCTGCCCTATCGCCACCTCTACCGGCCCAATGTGATCGG
CACCGCGGAGATCATTCACCTGGCGATCACGACGCGGCTGAAATCGGTGGACTTCATCTCCAGCATCGGGG

FIG. 8J

```
TGGCTTCCCTGCCCCGGCGGCCGGGAGGGAGCATCCCGGTGGAGGCGGCTACGCCCGGGGCTACTTCGCC
AGCAAGTGGGCTTGCGAGCAACTGCTGCGCTCCACCCATGACTGCACCGGTGTGCCCGTACGGGTGATTCG
GCCCAGCCTCATTCTTCCCGATCGTGTGCTGGCCGGGGAGATGAACCCGGACGATCTGCTTTCAAGACTGC
TGTACAGCATCCTGGTGACCGGGATCGCCCCCGGGTGCTTTGGGGAGGAGTCGCAGAACAGTGGACGATCG
GGGTTCTCGGTGCAGGGCCTCCCCGTCGACCAGTTGGCGCAGACCATCCTTGCCCTCGGGGAAGCGCGCAC
GGAGGGATTTCATGTGCTCAACCTCAACGCTGACAGTGGCAGCGGTGTTCCCCTGGATGCCATCCTCCAGG
ACATCGCCGCCAAAGGAATCAGGCTGCGACGGGTGGAGGGCTATGACCTCTGGCTCGACGCGATCACAACC
CGCCTGCGTCGCCTGCCAGCCGAGCAACGGGCCCGTTCCCTGCTGGATGTGGCGGAAGCCTATGCAGGATC
AGCAGGCCAGACAACGCAGAGCAGCGGTGAAATGCAGGCGGGCAGCAGCTCCTGCCCGGAGGAGATCACCA
GCCTGCAACCGGACTTCAGTAGGGCCTACAGGCGCAAGATCGTGGATGATCTGGCTCGGTGGGGCTGATC
GAGCCTCCAGGACCCGTGGATCAGTGA
```

Amino acid sequence (SEQ ID NO:28)

```
>gi|254431429|ref|ZP_05045132.1| putative long-chain fatty-acid--CoA
ligase [Cyanobium sp. PCC 7001]

MNESSADQSSGNVSEGWPDASVTARALQAHLRYEQIIDAILSGYAERPALAERSYLVRPDPSTGQTVRVH
EQAFRSISYRTLQERVHALTMAWRLHPDSPVQAGAFVVLVGFASIDYAVLDLALAYTKGVPVPLSPNHSS
EDDDAILGTVQPVTLAVSISEFSGCVDLIARSTSIRTVIVFDLDPAVDCERAALESGIRALNEKGSDVVV
QTLQDLIDVGRDAEFSFLPIQAQDQDDLALLIHTSGSTGTPKGACISSRALINTWRHVSGPYPKVTVVLA
PFHHMMGRDSMITALGAGGTAYFTLRPDLSTVIEDIRLARPTGLVLFPRLCEVIEHHLTTAPEYSGNEIL
GGRLQSIVVASAPITPRLKASLECLLGVPVSEGYSSTETASGGLAMNGLLNRNNILAYRLRDVPEAGYSV
NDRPFPRGELCVKTRFGISGYFRNPEATAELFDDDGFYCTGDIVEERAPDQIAIIDRRKNVIKLAQGEYV
AVGRLEQLFQEGCGCVQQIHLHGDSTRAYLLAVVVPDRNTLAPPGSRQASEAELKARVREEILTLANQRE
LRGFEIPRDLILAEEPFSQQNGLLSSLGKPIRPAIRARYRSRLESLYASHEATRGTELEAIRASAGAVDV
ETTLLALLSSTLGVVCGAADRQTSFRELGGDSLAAVQLAMEIKKQFGVGLEGSQILGPGGTVEAWARRIH
TASIQQAPHQRVGSPLAAIPAEGWLKPDHYRLENLIGIPIGTPSAEVARPTGGPPTVLLTGATGFLGGRL
CLEWLQRLAGQGGRLICLVRPSNSHSAWERLRNRFSHLEPEQVARFRELAGRHLEVIPADIGEPGLGLEP
GCQERLATEVDAICHCAAEVNHRLPYRHLYRPNVIGTAEIIHLAITTRLKSVDFISSIGVASLPRRPGGS
IPVEGGYARGYFASKWACEQLLRSTHDCTGVPVRVIRPSLILPDRVLAGEMNPDDLLSRLLYSILVTGIA
PGCFGEESQNSGRSGFSVQGLPVDQLAQTILALGEARTEGFHVLNLNADSGSGVPLDAILQDIAAKGIRL
RRVEGYDLWLDAITTRLRRLPAEQRARSLLDVAEAYAGSAGQTTQSSGEMQAGSSSCPEEITSLQPDFSR
AYRRKIVDDLARWGLIEPPGPVDQ
```

YP 882653.1

Nucleotide sequence (SEQ ID NO:29)

```
>uniprot|A0QIB5|A0QIB5_MYCA1 Putative acyl-CoA dehydrogenase

ATGTCGACTGCCACCCATGACGAACGACTCGACCGTCGCGTCCACGAACTCATCGCCACC
GACCCGCAATTCGCCGCCGCCCAACCCGACCCGGCGATCACCGCCGCCCTCGAACAGCCC
GGGCTGCGGCTGCCGCAGATCATCCGCACCGTGCTCGACGGCTACGCCGACCGGCCGGCG
CTGGACAGCGCGTGGTGGAGTTCGTCACGGACGCCAAGACCGGGCGCACGTCGGCGCAG
CTGCTCCCCGCTTCGAGACCATTACGTACGGCGAAGTGGCGCAGCGTGTTTCGGCGCTG
GGCCGCGCCCTGTCTGACGACGCGGTGCACCCCGGCGACCGGGTGTGCGTGCTGGGCTTC
```

FIG. 8K

```
AACAGCGTCGACTACGCCACCATCGACATGGCGCTGGGCGCCATCGGCGCCGTCTCGGTG
CCGCTGCAGACCAGCGCGGCAATCAGCTCGCTGCAGCCGATCGTGGCCGAGACCGAGCCC
ACCCTGATCGCGTCCAGCGTGAACCAGCTGTCCGACGCGGTGCAGCTGATCACCGGCGCC
GAGCAGGCGCCCACCCGGCTGGTGGTGTTCGACTACCACCGCAGGTCGACGACCAGCGC
GAGGCCGTCCAGGACGCCGCGGCGCGGCTGTCCGGCACCGGCGTGGCCGTCCAGACGCTG
GCCGAGCTGCTGGAGCGCGGCAAGGACCTGCCCGCCGTCGCGGAGCCGCCCGCCGACGAG
GACTCGCTGGCCCTGCTGATCTACACCTCCGGGTCCACCGGCGCCCCAAGGGCGCGATG
TACCCGCAGAGCAACGTCGGCAAGATGTGGCGCCGCGGCAGCAAGAACTGGTTCGGCGAG
AGCGCCGCGTCGATCACCCTGAATTTCATGCCGATGAGCCACGTGATGGGCCGAAGCATC
CTCTACGGCACGCTGGGCAACGGCGGCACCGCCTACTTCGCCGCCCGCAGCGACCTGTCC
ACCCTGCTCGAGGACCTCGAGCTGGTGCGGCCCACCGAGCTCAACTTCGTCCCGCGGATC
TGGGAGACGCTGTACGGCGAATTCCAGCGTCAGGTCGAGCGGCGGCTCTCCGAGGCCGGG
GACGCCGGCGAACGTCGCGCCGTCGAGGCCGAGGTGCTGGCCGAGCAGCGCCAGTACCTG
CTGGGCGGGCGGTTCACCTTCGCGATGACGGGCTCGGCGCCCATCTCGCCCGAGCTGCGC
AACTGGGTCGAGTCGCTGCTCGAAATGCACCTGATGGACGGCTACGGCTCCACGGAGGCC
GGAATGGTGTTGTTCGACGGGGAGATTCAGCGCCCGCCGGTGGTCGACTACAAGCTGGTC
GACGTGCCGGACCTGGGCTACTTCAGCACCGACCGGCCGCATCCGCGCGGCGAGCTGCTG
CTGCGCACCGAGAACATGTTCCCGGGCTACTACAAGCGGGCCGAAACCACCGCGGGCGTC
TTCGACGAGGACGGCTACTACCGCACCGGCGACGTGTTCGCCGAGATCGCCCCGGACCGG
CTGGTCTACGTCGACCGCCGCAACAACGTGCTCAAGCTGGCGCAGGGCGAATTCGTCACG
CTGGCCAAGCTGGAGGCGGTGTTCGGCAACAGCCCGCTGATCCGCCAGATCTACGTCTAC
GGCAACAGCGCCCAGCCCTACCTGCTGGCGGTCGTGGTGCCCACCGAGGAGGCGCTGGCC
TCGGGTGACCCCGAGACGCTCAAGCCCAAGATCGCCGACTCGCTGCAGCAGGTCGCCAAG
GAGGCCGGCCTGCAGTCCTACGAGGTGCCGCGCGACTTCATCATCGAGACCACCCCGTTC
AGCCTGGAAAACGGTCTGCTGACCGGGATCCGGAAGCTGGCGTGGCCGAAACTGAAGCAG
CACTACGGGGAACGGCTGGAGCAGATGTACGCCGACCTGGCCGCCGGACAGGCCGACGAG
CTGGCCGAGCTGCGCCGCAACGGTGCCCAGGCGCCGGTGTTGCAGACCGTGAGCCGCGCC
GCGGGCGCCATGCTGGGTTCGGCCGCCTCCGACCTGTCCCCGACGCCCACTTCACCGAT
CTGGGCGGAGACTCGTTGTCGGCGTTGACATTCGGCAACCTGCTGCGCGAGATCTTCGAC
GTCGACGTGCCGGTGGGCGTGATCGTCAGCCCGGCCAACGACCTGGCGGCCATCGCGAGC
TACATCGAGGCCGAGCGGCAGGGCAGCAAGCGCCCGACGTTCGCCTCGGTGCACGGCCGG
GACGCGACCGTGGTGCGCGCCGCCGACCTGACGCTGGACAAGTTCCTCGACGCCGACACG
CTGGCCTCCGCGCCGAACCTGCCCAAGCCGGCCACCGAGGTGCGCACCGTGCTGCTGACC
GGCGCCACCGGCTTCCTGGGCCGCTACCTGGCCCTGGAATGGCTGGAGCGGATGGACATG
GTGGACGGCAAGGTCATCGCCCTGGTCCGGGCCCGCTCCGACGAGGAGGCACGCGCCCGG
CTGGACAAGACCTTCGACAGCGGCGACCCGAAGCTGCTCGCGCACTACCAGCAGCTGGCT
GCCGATCACCTGGAGGTCATCGCCGGCGACAAGGGCGAGGCCAATCTGGGCCTGCGCCAA
GATGTTTGGCAACGGCTGGCCGACACGGTCGACGTGATCGTCGACCCCGCCGCGCTGGTC
AACCACGTGTTGCCGTACAGCGAGCTGTTCGGGCCCAACGCCCTGGGCACCGCGGAGCTG
ATCCGGCTGGCGCTGACGTCCAAGCAGAAGCCGTACACCTACGTGTCCACCATCGGCGTG
GGCGACCAGATCGAGCCGGGCAAGTTCGTCGAGAACGCCGACATCCGGCAGATGAGCGCC
ACCCGGGCGATCAACGACAGCTACGCCAACGGCTACGGCAACAGCAAGTGGGCCGGCGAG
GTGCTGCTGCGCGAGGCGCACGACCTGTGCGGGCTGCCCGTCGCGGTGTTCCGCTGCGAC
ATGATCCTGGCCGACACCACGTATGCCGGGCAGCTCAACCTGCCGGACATGTTCACCCGG
CTGATGCTGAGCCTGGTGGCCACCGGGATCGCGCCCGGCTCGTTCTACGAGCTCGACGCC
GACGGCAACCGGCAGCGGGCGCACTACGACGGCCTGCCGGTCGAGTTCATCGCCGCGGCG
ATCTCGACGCTGGGTTCGCAGATCACCGACAGCGACACCGGCTTCCAGACCTACCACGTG
ATGAACCCCTACGATGACGGCATCGGTCTGGACGAGTACGTCGATTGGCTGGTGGACGCC
GGCTATTCGATCGAGCGGATCGCCGACTACTCCGAATGGCTGCGGCGGTTCGAGACCTCG
CTGCGGGCCCTGCCGGACCGGCAGCGCCAGTACTCGCTGCTGCCGCTGCTGCACAACTAC
CGCACGCCCGAGAAGCCGATCAACGGGTCGATAGCTCCCACCGACGTGTTCCGGGCAGCG
GTGCAGGAGGCGAAAATCGGCCCCGACAAAGACATTCCGCACGTGTCGCCGCCGGTCATC
GTCAAGTACATCACCGACCTGCAGCTGCTCGGGCTGCTCTGA
```

FIG. 8L

Amino acid sequence (SEQ ID NO:30)

>uniprot|A0QIB5|A0QIB5_MYCA1 Putative acyl-CoA dehydrogenase

```
MSTATHDERLDRRVHELIATDPQFAAAQPDPAITAALEQPGLRLPQIIRT
VLDGYADRPALGQRVVEFVTDAKTGRTSAQLLPRFETITYGEVAQRVSAL
GRALSDDAVHPGDRVCVLGFNSVDYATIDMALGAIGAVSVPLQTSAAISS
LQPIVAETEPTLIASSVNQLSDAVQLITGAEQAPTRLVVFDYHPQVDDQR
EAVQDAAARLSGTGVAVQTLAELLERGKDLPAVAEPPADEDSLALLIYTS
GSTGAPKGAMYPQSNVGKMWRRGSKNWFGESAASITLNFMPMSHVMGRSI
LYGTLGNGGTAYFAARSDLSTLLEDLELVRPTELNFVPRIWETLYGEFQR
QVERRLSEAGDAGERRAVEAEVLAEQRQYLLGGRFTFAMTGSAPISPELR
NWVESLLEMHLMDGYGSTEAGMVLFDGEIQRPPVVDYKLVDVPDLGYFST
DRPHPRGELLLRTENMFPGYYKRAETTAGVFDEDGYYRTGDVFAEIAPDR
LVYVDRRNNVLKLAQGEFVTLAKLEAVFGNSPLIRQIYVYGNSAQPYLLA
VVVPTEEALASGDPETLKPKIADSLQQVAKEAGLQSYEVPRDFIIETTPF
SLENGLLTGIRKLAWPKLKQHYGERLEQMYADLAAGQADELAELRRNGAQ
APVLQTVSRAAGAMLGSAASDLSPDAHFTDLGGDSLSALTFGNLLREIFD
VDVPVGVIVSPANDLAAIASYIEAERQGSKRPTFASVHGRDATVVRAADL
TLDKFLDADTLASAPNLPKPATEVRTVLLTGATGFLGRYLALEWLERMDM
VDGKVIALVRARSDEEARARLDKTFDSGDPKLLAHYQQLAADHLEVIAGD
KGEANLGLRQDVWQRLADTVDVIVDPAALVNHVLPYSELFGPNALGTAEL
IRLALTSKQKPYTYVSTIGVGDQIEPGKFVENADIRQMSATRAINDSYAN
GYGNSKWAGEVLLREAHDLCGLPVAVFRCDMILADTTYAGQLNLPDMFTR
LMLSLVATGIAPGSFYELDADGNRQRAHYDGLPVEFIAAAISTLGSQITD
SDTGFQTYHVMNPYDDGIGLDEYVDWLVDAGYSIERIADYSEWLRRFETS
LRALPDRQRYSLLPLLHNYRTPEKPINGSIAPTDVFRAAVQEAKIGPDK
DIPHVSPPVIVKYITDLQLLGLL
```

YP 887275.1

Nucleotide sequence (SEQ ID NO:31)

>uniprot|A0QWI7|A0QWI7_MYCS2 NAD dependent epimerase/dehydratase family protein

```
ATGACGATCGAAACGCGCGAAGACCGCTTCAACCGGCGCATTGACCACTTGTTCGAAACC
GACCCGCAGTTCGCCGCCGCCCGTCCCGACGAGGCGATCAGCGCGGCTGCCGCCGATCCG
GAGTTGCGCCTTCCTGCCGCGGTCAAACAGATTCTGGCCGGCTATGCGGACCGCCCTGCG
CTGGGCAAGCGCGCCGTCGAGTTCGTCACCGACGAAGAAGGCCGCACCACCGCGAAGCTC
CTGCCCCGCTTCGACACCATCACCTACCGTCAGCTCGCAGGCCGGATCCAGGCCGTGACC
AATGCCTGGCACAACCATCCGGTGAATGCCGGTGACCGCGTGGCCATCCTGGGTTTCACC
AGTGTCGACTACACGACGATCGACATCGCCCTGCTCGAACTCGGCGCCGTGTCCGTACCG
CTGCAGACCAGTGCGCCGGTGGCCCAACTGCAGCCGATCGTCGCCGAGACCGAGCCCAAG
GTGATCGCGTCGAGCGTCGACTTCCTCGCCGACGCAGTCGCTCTCGTCGAGTCCGGGCCC
GCGCCGTCGCGACTGGTGGTGTTCGACTACAGCCACGAGGTCGACGATCAGCGTGAGGCG
TTCGAGGCGGCCAAGGGCAAGCTCGCAGGCACCGGCGTCGTCGTCGAGACGATCACCGAC
GCACTGGACCGCGGGCGGTCACTCGCCGACGCACCGCTCTACGTGCCCGACGAGGCCGAC
CCGCTGACCCTTCTCATCTACACCTCCGGCAGCACCGGCACTCCCAAGGGCGCGATGTAC
CCCGAGTCCAAGACCGCCACGATGTGGCAGGCCGGGTCCAAGGCCCGGTGGGACGAGACC
```

FIG. 8M

```
CTCGGCGTGATGCCGTCGATCACCCTGAACTTCATGCCCATGAGTCACGTCATGGGGCGC
GGCATCCTGTGCAGCACACTCGCCAGCGGCGGAACCGCGTACTTCGCCGCACGCAGCGAC
CTGTCCACCTTCCTGGAGGACCTCGCCCTCGTGCGGCCCACGCAGCTCAACTTCGTTCCT
CGCATCTGGGACATGCTGTTCCAGGAGTACCAGAGCCGCCTCGACAACCGCCGCGCCGAG
GGATCCGAGGACCGAGCCGAAGCCGCAGTCCTCGAAGAGGTCCGCACCCAACTGCTCGGC
GGGCGATTCGTTTCGGCCCTGACCGGATCGGCTCCCATCTCGGCGGAGATGAAGAGCTGG
GTCGAGGACCTGCTCGACATGCATCTGCTGGAGGGCTACGGCTCCACCGAGGCCGGCGCG
GTGTTCATCGACGGGCAGATCCAGCGCCCGCCGGTCATCGACTACAAGCTGGTCGACGTG
CCCGATCTCGGCTACTTCGCCACGGACCGGCCCTACCCGCGCGGCGAACTTCTGGTCAAG
TCCGAGCAGATGTTCCCCGGCTACTACAAGCGTCCGGAGATCACCGCCGAGATGTTCGAC
GAGGACGGGTACTACCGCACCGGCGACATCGTCGCCGAGCTCGGGCCCGACCATCTCGAA
TACCTCGACCGCCGCAACAACGTGCTGAAACTGTCGCAGGGCGAATTCGTCACGGTCTCC
AAGCTGGAGGCGGTGTTCGGCGACAGCCCCTGGTACGCCAGATCTACGTCTACGGCAAC
AGCGCGCGGTCCTATCTGCTGGCGGTCGTGGTCCCGACCGAAGAGGCACTGTCACGTTGG
GACGGTGACGAACTCAAGTCGCGCATCAGCGACTCACTGCAGGACGCGGCACGAGCCGCC
GGATTGCAGTCGTATGAGATCCCGCGTGACTTCCTCGTCGAGACAACACCTTTCACGCTG
GAGAACGGCCTGCTGACCGGTATCCGCAAGCTGGCCCGGCCGAAACTGAAGGCGCACTAC
GGCAACGCCTCGAACAGCTCTACACCGACCTGGCCGAGGGGCAGGCCAACGAGTTGCGC
GAGTTGCGCCGCAACGGAGCCGACCGGCCCGTGGTCGAGACCGTCAGCCGCGCCGCGGTC
GCACTGCTCGGTGCCTCCGTCACGGATCTGCGGTCCGATGCGCACTTCACCGATCTGGGT
GGAGATTCGTTGTCGGCCTTGAGCTTCTCGAACCTGTTGCACGAGATCTTCGATGTCGAC
GTGCCGGTCGGCGTCATCGTCAGCCCGGCCACCGACCTGGCAGGCGTCGCGGCCTACATC
GAGGGCGAACTGCGCGGCTCCAAGCGCCCCACATACGCGTCGGTGCACGGGCGCGACGCC
ACCGAGGTGCGCGCGCGTGATCTCGCCCTGGGCAAGTTCATCGACGCCAAGACCCTGTCC
GCCGCGCCGGGTCTGCCGCGTTCGGGCACCGAGATCCGCACCGTGCTGCTGACCGGCGCC
ACCGGGTTCCTGGGCCGCTATCTGGCGCTGGAATGGCTGGAGCGCATGGACCTGGTGGAC
GGCAAGGTGATCTGCCTGGTGCGCGCCCGCAGCGACGACGAGGCCCGGGCGCGTCTGGAC
GCCACGTTCGACACCGGGGACGCGACACTGCTCGAGCACTACCGCGCGCTGGCAGCCGAT
CACCTCGAGGTGATCGCCGGTGACAAGGGCGAGGCCGATCTGGGTCTCGACCACGACACG
TGGCAGCGACTGGCCGACACCGTCGATCTGATCGTCGATCCGGCCGCCCTGGTCAATCAC
GTCCTGCCGTACAGCCAGATGTTCGGACCCAATGCGCTCGGCACCGCCGAACTCATCCGG
ATCGCGCTGACCACCACGATCAAGCCGTACGTGTACGTCTCGACGATCGGTGTGGGACAG
GGCATCTCCCCGAGGCGTTCGTCGAGGACGCCGACATCCGCGAGATCAGCGCGACGCGC
CGGGTCGACGACTCGTACGCCAACGGCTACGGCAACAGCAAGTGGGCCGGCGAGGTCCTG
CTGCGGGAGGCGCACGACTGGTGTGGTCTGCCGGTCTCGGTGTTCCGCTGCGACATGATC
CTGGCCGACACGACCTACTCGGGTCAGCTGAACCTGCCGGACATGTTCACCCGCCTGATG
CTGAGCCTCGTGGCGACCGGCATCGCGCCCGGTTCGTTCTACGAACTCGATGCGGACGGC
AACCGGCAGCGCGCCCACTACGACGGGCTGCCCGTGGAGTTCATCGCCGAGGCGATCTCC
ACCATCGGCTCGCAGGTCACCGACGGATTCGAGACGTTCCACGTGATGAACCCGTACGAC
GACGGCATCGGCCTCGACGAGTACGTGGACTGGCTGATCGAGGCCGGCTACCCCGTGCAC
CGCGTCGACGACTACGCCACCTGGCTGAGCCGGTTCGAAACCGCACTGCGGGCCCTGCCG
GAACGGCAACGTCAGGCCTCGCTGCTGCCGCTGCTGCACAACTATCAGCAGCCCTCACCG
CCCGTGTGCGGTGCCATGGCACCCACCGACCGGTTCCGTGCCGCGGTGCAGGACGCGAAG
ATCGGCCCCGACAAGGACATTCCGCACGTCACGGCCGACGTGATCGTCAAGTACATCAGC
AACCTGCAGATGCTCGGATTGCTGTAA
```

Amino acid sequence (SEQ ID NO:32)

>uniprot|A0QWI7|A0QWI7_MYCS2 NAD dependent epimerase/dehydratase family protein

MTIETREDRFNRRIDHLFETDPQFAAARPDEAISAAAADPELRLPAAVKQ

FIG. 8N

ILAGYADRPALGKRAVEFVTDEEGRTTAKLLPRFDTITYRQLAGRIQAVT
NAWHNHPVNAGDRVAILGFTSVDYTTIDIALLELGAVSVPLQTSAPVAQL
QPIVAETEPKVIASSVDFLADAVALVESGPAPSRLVVFDYSHEVDDQREA
FEAAKGKLAGTGVVVETITDALDRGRSLADAPLYVPDEADPLTLLIYTSG
STGTPKGAMYPESKTATMWQAGSKARWDETLGVMPSITLNFMPMSHVMGR
GILCSTLASGGTAYFAARSDLSTFLEDLALVRPTQLNFVPRIWDMLFQEY
QSRLDNRRAEGSEDRAEAAVLEEVRTQLLGGRFVSALTGSAPISAEMKSW
VEDLLDMHLLEGYGSTEAGAVFIDGQIQRPPVIDYKLVDVPDLGYFATDR
PYPRGELLVKSEQMFPGYYKRPEITAEMFDEDGYYRTGDIVAELGPDHLE
YLDRRNNVLKLSQGEFVTVSKLEAVFGDSPLVRQIYVYGNSARSYLLAVV
VPTEEALSRWDGDELKSRISDSLQDAARAAGLQSYEIPRDFLVETTPFTL
ENGLLTGIRKLARPKLKAHYGERLEQLYTDLAEGQANELRELRRNGADRP
VVETVSRAAVALLGASVTDLRSDAHFTDLGGDSLSALSFSNLLHEIFDVD
VPVGVIVSPATDLAGVAAYIEGELRGSKRPTYASVHGRDATEVRARDLAL
GKFIDAKTLSAAPGLPRSGTEIRTVLLTGATGFLGRYLALEWLERMDLVD
GKVICLVRARSDDEARARLDATFDTGDATLLEHYRALAADHLEVIAGDKG
EADLGLDHDTWQRLADTVDLIVDPAALVNHVLPYSQMFGPNALGTAELIR
IALTTTIKPYVYVSTIGVGQGISPEAFVEDADIREISATRRVDDSYANGY
GNSKWAGEVLLREAHDWCGLPVSVFRCDMILADTTYSGQLNLPDMFTRLM
LSLVATGIAPGSFYELDADGNRQRAHYDGLPVEFIAEAISTIGSQVTDGF
ETFHVMNPYDDGIGLDEYVDWLIEAGYPVHRVDDYATWLSRFETALRALP
ERQRQASLLPLLHNYQQPSPPVCGAMAPTDRFRAAVQDAKIGPDKDIPHV
TADVIVKYISNLQMLGLL

ZP_05224908

Nucleotide sequence (SEQ ID NO:33)

>gi|163719654:2489-6013 Mycobacterium intracellulare ATCC 13950
NZ_ABIN01000072, whole genome shotgun sequence ATGTCGACTGCCATTCATGACGAACACCTCGACCGTCGCATCGAGGAACTCATCGCCAACGACCCCCAAT
TCGCCGCCGCCCGACCGGACCCGGCCATCACCGCCGCCACCGAAGCGCCCGGGCTGCGGCTGCCGCAGAT
CATCCGGACCGTGCTCGACGGCTACGCCGACCGGCCTGCCCTGGCGCAGCGCGTCGTGGAGTTCGTCACC
GACGCCAAGACCGGGCGGACGACGGCCGAGCTGCTCCCCGTTTCGAGACCATACGTATGGCGAACTCG
GCGAACGGGTTTCGGCCCTCGGCCGTGCCTGGGCCGGCGACGCGGTGCGCCCCGGCGACCGCGTCTGCGT
GCTCGGCTTCAACAGCGTTGACTACGCCACCATCGACATCGCGCTGGGCACCATCGGGGCCGTGTCGGTG
CCGCTGCAGACCAGCGCGGCGATCTCCTCGTTGCAGCCGATCGTCGCCGAGACCGAGCCCAGCCTGATCG
CCTCGAGCGTCAACCAGCTGCCCGACGCGGTGGAGCTGATCCTGGCCGGCGACCACGTGCCCGGCAAGCT
CGTCGTGTTCGACTACCAGCCCCAGGTCGACGACCAGCGCGAGGCCGTGGAGGCCGCCGCCGCGCGGTTG
GCCGACTCCGGCGTCGCGGTCGAGGCTCTCGCCGACGTGCTGCGGCGCGGCAAGGACCTGCCGGCCGTCG
AGCCGCCGGCGAGCGACGAGGACTCGCTGGCCCTGCTGATCTACACCTCCGGCAGCACCGGCGCGCCCAA
GGGCGCGATGTACCCGCAGAGCAACGTCGGCAAGATGTGGCGGCGCGGGAGCAAGAACTGGTTCGGGGAA
AGCGCCGCGTCGATCACCCTCAACTTCATGCCGATGAGCCACGTCATGGGGCGCGGAATCCTCTACGGCA
CGCTGGGCAACGGCGGCACCGCGTACTTCGCCGCCCGCAGCGACCTGTCCACCCTGCTCGAGGACCTCGA
GTTGGTGCGGCCCACCGAGATGAACTTCGTCCCCCGCATCTGGGAGACGCTGTACGGCGAATTCCAGCGC
CAGGTCGAGCGGCGGCTGGCCGACGGCGATGCGGGCCCGGAGGCCCGCGAGACTGTGGCGGCTGCGGTGT
TGGAAGAACAGCGCCAGTACCTGCTGGGCGGCGGTTCATCTTCGCGATGACGGGCTCGGCACCCACCTC
GCCGGAGCTCAAGGCGTGGGCCGAGTCGCTCCTGCAGATGCACCTGATGGACGGCTACGGCTCCACCGAG
GCCGGAATGGTGTTGTTCGACGGGAGATTCAGCGTCCGCCGGTTATTGATTACAAGCTGGTCGACGTTC
CGGATCTGGCTATTTCAGCACCGACCGTCCGCATCCGCGCGGTGAGTTGTTGCTGCGGACCGAGAACAT
GTTCCCGGGTTATTACAAGCGGGCCGAGACCACCGCGAACGTGTTCGACGAGGACGGTTATTACCGCACC

FIG. 8O

```
GGTGACGTGTTCGCCGAGATCGCGCCGGACCGGCTGGTGTATGTCGATCGCCGCAACAACGTGCTCAAGT
TGGCCCAGGGCGAGTTCGTGACGCTGGCCAAGCTGGAGGCGGTGTTCGGCAACAGCCCGCTGATCCGCCA
GATCTACGTTTACGGCAACAGCTCCCAGCCCTACCTGCTGGCCGTGGTGGTGCCGACCGAGGAAGCGTTG
GCGGACAACGATCTTGAGTCGCTCAAGCCGAAGATCGCCGACTCGCTGCAGAAGGTCGCCAAGGAGACCG
GCCTGCAGTCCTACGAGGTGCCGCGCGACTTCATCATCGAGACCACGCCGTTCACCCTGGAAAACGGCCT
GCTGACCGGGATCCGCAAGCTGGCGTGGCCCAAGCTCAAGGCGCACTACGGGGATCGGCTCGAGCAGATG
TATGCCGAGCTGGCCGCGGGACAGGCCAACGAGTTGGCCGAACTGCGCCGCAGCGGCGCGGCGGCGCCGG
TGGCCCAGACCGTGAGCCGGGCCGCGGCCGCCCTGCTGGGTGCGACGGCCGGGGATCTGTCCGCAGATGC
CCACTTCACCGATCTTGGTGGAGACTCGTTGTCGGCGTTGACCTTCGGCAACCTGCTGCGCGAGATCTTC
GATGTCGACGTGCCGGTGGGGGTGATCGTCAGCCCGGCCAACGACCTGGCGGGGATCGCCGCCTACATCG
AGGCCGAGCGGCAGGGCTCCAAGCGCCCGACGTTCGCCGCCGTGCACGGTCGCGGTGCGACCATGGTGCA
CGCCAGTGACCTCACGCTGGACAAGTTCCTCGACGAGGCGACCCTGGCCGCCGCGCCCAGCCTGCCCAAG
CCGGCCACCGAGGTGCGCACCGTGCTGTTGACCGGCGCGACCGGCTTTTTGGGCCGCTACCTGGCGCTGG
ACTGGCTCGAGCGGATGGACATGGTCGACGGCAAGGTCATCGCCCTGGTGCGGGCCCGCACCGATGAGGA
GGCGCGCGCCCGGCTGGACAAGACCTTCGACAGCGGCGACCCCAAACTGCTGGCGCACTACCAGCGGCTG
GCCGCCGACCACCTCGAGGTCATCGCCGGCGACAAGGGTGAGGCCAACCTCGGCCTGGACCCCCAGACCT
GGCAGCGACTGGCCGAGGAGGTCGACGTCATCGTCGACCCCGCCGCGCTGGTCAACCACGTGCTGCCCTA
CAGCGAGCTGTTCGGCCCCAACGCCCTGGGCACCGCGGAGCTGATCCGGATCGCGCTGACCTCCAGGCAA
AAGCCCTACACCTACGTGTCGACGATCGGGGTGGGCGATCAGATCCAGCCAGGTGAGTTCGTCGAGAACG
CCGACATCCGCCAGATCAGCGCCACCCGCGAGATCAACGACGGCTACGCCAACGGCTACGGCAACAGCAA
GTGGGCCGGCGAGGTGTTGCTGCGCGAGGCCCACGACCTGTGCGGCCTGCCCGTCACGGTGTTCCGCTGC
GACATGATCCTGGCCGACACCACCTATGCCGGGCAGCTCAACCTGCCCGACATGTTCACCCGGCTGATGC
TGAGCCTGGTCGCCACCGGTATCGCGCCCGGGTCGTTCTACGAACTGGACGCCGACGGCAACCGCCAGCG
GGCACACTACGACGGTTTGCCGGTCGAGTTCATCGCCGCGGCGATCTCGACGCTGGGGACCCAAATCACC
GACAGCGACACGGGCTTTCAGACCTACCACGTGATGAACCCCTACGACGACGGCATCGGGCTGGATGAGT
ACATCGATTGGCTGATCGAGGCCGGGTATTCGATCGAGCGGATCGCCGATTACTCCGAGTGGCTGCGGCG
CTTCGAGACCTCGCTGCGGGCCCTGCCCGATCGGCAGCGTCAGTACTCGCTGCTGCCGCTGCTGCACAAC
TACCAGAAGCCGGAAAAGCCGATCAACGGCTCGATGGCGCCCACCGACGTGTTCCGTGCCGCGGTGCAGG
AAGCGAAAATCGGCCCCGACAAAGACATCCCGCACGTCTCGGCGCCGGTGATCGTCAAGTACATCACCGA
CCTGGAGTTGCTCGGACTCCTCTGA
```

Amino acid sequence (SEQ ID NO:34)

>gi|254819907|ref|ZP_05224908.1| FadD9 [Mycobacterium intracellulare ATCC 13950]

MSTAIHDEHLDRRIEELIANDPQFAAARPDPAITAATEAPGLRLPQIIRTVLDGYADRPALAQRVVEFVT
DAKTGRTTAELLPRFETITYGELGERVSALGRAWAGDAVRPGDRVCVLGFNSVDYATIDIALGTIGAVSV
PLQTSAAISSLQPIVAETEPSLIASSVNQLPDAVELILAGDHVPGKLVVFDYQPQVDDQREAVEAAAARL
ADSGVAVEALADVLRRGKDLPAVEPPASDEDSLALLIYTSGSTGAPKGAMYPQSNVGKMWRRGSKNWFGE
SAASITLNFMPMSHVMGRGILYGTLGNGGTAYFAARSDLSTLLEDLELVRPTEMNFVPRIWETLYGEFQR
QVERRLADGDAGPEARETVAAAVLEEQRQYLLGGRFIFAMTGSAPTSPELKAWAESLLQMHLMDGYGSTE
AGMVLFDGEIQRPPVIDYKLVDVPDLGYFSTDRPHPRGELLLRTENMFPGYYKRAETTANVFDEDGYYRT
GDVFAEIAPDRLVYVDRRNNVLKLAQGEFVTLAKLEAVFGNSPLIRQIYVYGNSSQPYLLAVVVPTEEAL
ADNDLESLKPKIADSLQKVAKETGLQSYEVPRDFIIETTPFTLENGLLTGIRKLAWPKLKAHYGDRLEQM
YAELAAGQANELAELRRSGAAAPVAQTVSRAAAALLGATAGDLSADAHFTDLGGDSLSALTFGNLLREIF
DVDVPVGVIVSPANDLAGIAAYIEAERQGSKRPTFAAVHGRGATMVHASDLTLDKFLDEATLAAAPSLPK
PATEVRTVLLTGATGFLGRYLALDWLERMDMVDGKVIALVRARTDEEARARLDKTFDSGDPKLLAHYQRL
AADHLEVIAGDKGEANLGLDPQTWQRLAEEVDVIVDPAALVNHVLPYSELFGPNALGTAELIRIALTSRQ
KPYTYVSTIGVGDQIQPGEFVENADIRQISATREINDYANGYGNSKWAGEVLLREAHDLCGLPVTVFRC
DMILADTTYAGQLNLPDMFTRLMLSLVATGIAPGSFYELDADGNRQRAHYDGLPVEFIAAAISTLGTQIT

FIG. 8P

DSDTGFQTYHVMNPYDDGIGLDEYIDWLIEAGYSIERIADYSEWLRRFETSLRALPDRQRQYSLLPLLHN
YQKPEKPINGSMAPTDVFRAAVQEAKIGPDKDIPHVSAPVIVKYITDLELLGLL

YP 889972.1

Nucleotide sequence (SEQ ID NO:35)

>uniprot|A0R484|A0R484_MYCS2 Putative long-chain fatty-acid--CoA ligase

```
ATGACCAGCGATGTTCACGACGCCACAGACGGCGTCACCGAAACCGCACTCGACGACGAG
CAGTCGACCCGCCGCATCGCCGAGCTGTACGCCACCGATCCCGAGTTCGCCGCCGCCGCA
CCGTTGCCCGCCGTGGTCGACGCGGCGCACAAACCCGGGCTGCGGCTGGCAGAGATCCTG
CAGACCCTGTTCACCGGCTACGGTGACCGCCCGGCGCTGGGATACCGCGCCCGTGAACTG
GCCACCGACGAGGGCGGGCGCACCGTGACGCGTCTGCTGCCGCGGTTCGACACCCTCACC
TACGCCCAGGTGTGGTCGCGCGTGCAAGCGGTCGCCGCGGCCCTGCGCCACAACTTCGCG
CAGCCGATCTACCCCGGCGACGCCGTCGCGACGATCGGTTTCGCGAGTCCCGATTACCTG
ACGCTGGATCTCGTATGCGCCTACCTGGGCCTCGTGAGTGTTCCGCTGCAGCACAACGCA
CCGGTCAGCCGGCTCGCCCCGATCCTGGCCGAGGTCGAACCGCGGATCCTCACCGTGAGC
GCCGAATACCTCGACCTCGCAGTCGAATCCGTGCGGGACGTCAACTCGGTGTCGCAGCTC
GTGGTGTTCGACCATCACCCCGAGGTCGACGACCACCGCGACGCACTGGCCCGCGCGCGT
GAACAACTCGCCGGCAAGGGCATCGCCGTCACCACCCTGGACGCGATCGCCGACGAGGGC
GCCGGGCTGCCGGCCGAACCGATCTACACCGCCGACCATGATCAGCGCCTCGCGATGATC
CTGTACACCTCGGGTTCCACCGGCGCACCCAAGGGTGCGATGTACACCGAGGCGATGGTG
GCGCGGCTGTGGACCATGTCGTTCATCACGGGTGACCCCACGCCGGTCATCAACGTCAAC
TTCATGCCGCTCAACCACCTGGGCGGGCGCATCCCCATTTCCACCGCCGTGCAGAACGGT
GGAACCAGTTACTTCGTACCGGAATCCGACATGTCCACGCTGTTCGAGGATCTCGCGCTG
GTGCGCCCGACCGAACTCGGCCTGGTTCCGCGCGTCGCCGACATGCTCTACCAGCACCAC
CTCGCCACCGTCGACCGCCTGGTCACGCAGGGCGCCGACGAACTGACCGCCGAGAAGCAG
GCCGGTGCCGAACTGCGTGAGCAGGTGCTCGGCGGACGCGTGATCACCGGATTCGTCAGC
ACCGCACCGCTGGCCGCGGAGATGAGGGCGTTCCTCGACATCACCCTGGGCGCACACATC
GTCGACGGCTACGGGCTCACCGAGACCGGCGCCGTGACACGCGACGGTGTGATCGTGCGG
CCACCGGTGATCGACTACAAGCTGATCGACGTTCCCGAACTCGGCTACTTCAGCACCGAC
AAGCCCTACCCGCGTGGCGAACTGCTGGTCAGGTCGCAAACGCTGACTCCCGGGTACTAC
AAGCGCCCCGAGGTCACCGCGAGCGTCTTCGACCGGGACGGCTACTACCACACCGGCGAC
GTCATGGCCGAGACCGCACCCGACCACCTGGTGTACGTGGACCGTCGCAACAACGTCCTC
AAACTCGCGCAGGGCGAGTTCGTGGCGGTCGCCAACCTGGAGGCGGTGTTCTCCGGCGCG
GCGCTGGTGCGCCAGATCTTCGTGTACGGCAACAGCGAGCGCAGTTTCCTTCTGGCCGTG
GTGGTCCCGACGCCGGAGGCGCTCGAGCAGTACGATCCGGCCGCGCTCAAGGCCGCGCTG
GCCGACTCGCTGCAGCGCACCGCACGCGACGCCGAACTGCAATCCTACGAGGTGCCGGCC
GATTTCATCGTCGAGACCGAGCCGTTCAGCGCCGCCAACGGGCTGCTGTCGGGTGTCGGA
AAACTGCTGCGGCCCAACCTCAAAGACCGCTACGGGCAGCGCCTGGAGCAGATGTACGCC
GATATCGCGGCCACGCAGGCCAACCAGTTGCGCGAACTGCGGCGCGCGGCCGCCACACAA
CCGGTGATCGACACCCTCACCCAGGCCGCTGCCACGATCCTCGGCACCGGGAGCGAGGTG
GCATCCGACGCCCACTTCACCGACCTGGGCGGGGATTCCCTGTCGGCGCTGACACTTTCG
AACCTGCTGAGCGATTTCTTCGGTTTCGAAGTTCCCGTCGGCACCATCGTGAACCCGGCC
ACCAACCTCGCCCAACTCGCCCAGCACATCGAGGCGCAGCGCACCGCGGGTGACCGCAGG
CCGAGTTTCACCACCGTGCACGGCGCGGACGCCACCGAGATCCGGGCGAGTGAGCTGACC
CTGGACAAGTTCATCGACGCCGAAACGCTCCGGGCCGCACCGGGTCTGCCCAAGGTCACC
ACCGAGCCACGGACGGTGTTGCTCTCGGGCGCCAACGGCTGGCTGGGCCGGTTCCTCACG
TTGCAGTGGCTGGAACGCCTGGCACCTGTCGGCGGCACCCTCATCACGATCGTGCGGGGC
CGCGACGACGCCGCGGCCCGCGCACGGCTGACCCAGGCCTACGACACCGATCCCGAGTTG
TCCCGCCGCTTCGCCGAGCTGGCCGACCGCCACCTGCGGGTGGTCGCCGGTGACATCGGC
```

FIG. 8Q

```
GACCCGAATCTGGGCCTCACACCCGAGATCTGGCACCGGCTCGCCGCCGAGGTCGACCTG
GTGGTGCATCCGGCAGCGCTGGTCAACCACGTGCTCCCCTACCGGCAGCTGTTCGGCCCC
AACGTCGTGGGCACGGCCGAGGTGATCAAGCTGGCCCTCACCGAACGGATCAAGCCCGTC
ACGTACCTGTCCACCGTGTCGGTGGCCATGGGGATCCCCGACTTCGAGGAGGACGGCGAC
ATCCGGACCGTGAGCCCGGTGCGCCCGCTCGACGGCGGATACGCCAACGGCTACGGCAAC
AGCAAGTGGGCCGGCGAGGTGCTGCTGCGGGAGGCCCACGATCTGTGCGGGCTGCCCGTG
GCGACGTTCCGCTCGGACATGATCCTGGCGCATCCGCGCTACCGCGGTCAGGTCAACGTG
CCAGACATGTTCACGCGACTCCTGTTGAGCCTCTTGATCACCGGCGTCGCGCCGCGGTCG
TTCTACATCGGAGACGGTGAGCGCCCGCGGGCGCACTACCCCGGCCTGACGGTCGATTTC
GTGGCCGAGGCGGTCACGACGCTCGGCGCGCAGCAGCGCGAGGGATACGTGTCCTACGAC
GTGATGAACCCGCACGACGACGGGATCTCCCTGGATGTGTTCGTGGACTGGCTGATCCGG
GCGGGCCATCCGATCGACCGGGTCGACGACTACGACGACTGGGTGCGTCGGTTCGAGACC
GCGTTGACCGCGCTTCCCGAGAAGCGCCGCGCACAGACCGTACTGCCGCTGCTGCACGCG
TTCCGCGCTCCGCAGGCACCGTTGCGCGGCGCACCCGAACCCACGGAGGTGTTCCACGCC
GCGGTGCGCACCGCGAAGGTGGGCCCGGGAGACATCCCGCACCTCGACGAGGCGCTGATC
GACAAGTACATACGCGATCTGCGTGAGTTCGGTCTGATCTGA
```

Amino acid sequence (SEQ ID NO:36)

>uniprot|A0R484|A0R484_MYCS2 Putative long-chain fatty-acid--CoA ligase

```
MTSDVHDATDGVTETALDDEQSTRRIAELYATDPEFAAAAPLPAVVDAAH
KPGLRLAEILQTLFTGYGDRPALGYRARELATDEGGRTVTRLLPRFDTLT
YAQVWSRVQAVAAALRHNFAQPIYPGDAVATIGFASPDYLTLDLVCAYLG
LVSVPLQHNAPVSRLAPILAEVEPRILTVSAEYLDLAVESVRDVNSVSQL
VVFDHHPEVDDHRDALARAREQLAGKGIAVTTLDAIADEGAGLPAEPIYT
ADHDQRLAMILYTSGSTGAPKGAMYTEAMVARLWTMSFITGDPTPVINVN
FMPLNHLGGRIPISTAVQNGGTSYFVPESDMSTLFEDLALVRPTELGLVP
RVADMLYQHHLATVDRLVTQGADELTAEKQAGAELREQVLGGRVITGFVS
TAPLAAEMRAFLDITLGAHIVDGYGLTETGAVTRDGVIVRPPVIDYKLID
VPELGYFSTDKPYPRGELLVRSQTLTPGYYKRPEVTASVFDRDGYYHTGD
VMAETAPDHLVYVDRRNNVLKLAQGEFVAVANLEAVFSGAALVRQIFVYG
NSERSFLLAVVVPTPEALEQYDPAALKAALADSLQRTARDAELQSYEVPA
DFIVETEPFSAANGLLSGVGKLLRPNLKDRYGQRLEQMYADIAATQANQL
RELRRAAATQPVIDTLTQAAATILGTGSEVASDAHFTDLGGDSLSALTLS
NLLSDFFGFEVPVGTIVNPATNLAQLAQHIEAQRTAGDRRPSFTTVHGAD
ATEIRASELTLDKFIDAETLRAAPGLPKVTTEPRTVLLSGANGWLGRFLT
LQWLERLAPVGGTLITIVRGRDDAAARARLTQAYDTDPELSRRFAELADR
HLRVVAGDIGDPNLGLTPEIWHRLAAEVDLVVHPAALVNHVLPYRQLFGP
NVVGTAEVIKLALTERIKPVTYLSTVSVAMGIPDFEEDGDIRTVSPVRPL
DGGYANGYGNSKWAGEVLLREAHDLCGLPVATFRSDMILAHPRYRGQVNV
PDMFTRLLLSLLITGVAPRSFYIGDGERPRAHYPGLTVDFVAEAVTTLGA
QQREGYVSYDVMNPHDDGISLDVFVDWLIRAGHPIDRVDDYDDWVRRFET
ALTALPEKRRAQTVLPLLHAFRAPQAPLRGAPEPTEVFHAAVRTAKVGPG
DIPHLDEALIDKYIRDLREFGLI
```

Nucleotide sequence (SEQ ID NO:37)

>gi|218125542:1370-4894 Mycobacterium kansasii ATCC 12478
NZ_ACBV01000156, whole genome shotgun sequence atgtcgactaccactcgtgacgagcgcctcgagcgccgcatcgacaccctgatccacgacgacgcacagtt
cgccgccgccaagccggacccggcaatcgccgccgccctggaaaagcccggcctgagcctgccagagatca
tccagaccgcgctgcagggctacgccgaccggccggctctcgggcagcgcgccgtcgagttcgtcacggac
acccagaccggccgcacctcggtgcggctgctgacccgcttcgagaccatcacctaccgtcagctcggcga
ccgggtcggtgcgctggcgcgcgccctgacccacgactcggtgcacgccggcgaccgggtctgcgtgctgg
gcttcaacagcctcgactacaccaccatcgacatggcgctggcgaaggtcggcgcggtgtcggtgccgctg
cagaccagtgcggcggttacccagctgcagccgatcgtggccgagaccgagcccaccatgatggcggccag
tgtgaatcagctgtcggatgccgtggacgtgctgttgagcggccacctgccggccaagctggtggtgttcg
actaccaccccgaggtggacgaccagcgcgaggcgctcgacacggcccgggagcggttggcggacacagcg
gtggttgtccagaccctcaaggacgtcctggaccacggcgcaacgctggcggcgggtcggttgccgagcc
gctcgcggcgtcgggcgacaacgactcgctggcgctgctgatctacacctccggcagcaccggcgcaccca
aaggtgcgatgtatcgacagagcaacgtcggcaagatgtggcgccggtcgagcaagaactggttcgggccc
accgcggcgtcgatcaccctcaacttcatgccgatgagccacatcatgggacgtggagtcctctacggcac
gctcggcaacggcggcaccgcgtacttcgcggccaggagcgacctctcgacgctgctggaagacttgcggc
tggtgcggcccaccgagttgaacttcgtgccgcggatctgggagaccttgtacggcgaataccagcgcgcg
gtcgaccagcggtcggtcgatcccggtgaacccgccgcccgcgaagccgtcgaagcccaggtcatggccga
gcagcgccaggacctgctgggtgggcgctatatcttcgcgatgacgggctcggcgcccatgtccccggagc
tgcggaactgggtggaagcgctgctggagatcccactgctcgacggttacggctccaccgaggccgggatg
gtcatgttcgacggtgaaattcagcgcccgccggtgatcgactacaagctggtcgacgtgcccgatctggg
ctacttcagcaccgaccagccgtatccgcggggcgagttgctgctcaagaccgagaacatgttcccaggct
attacaagcggccggaggttacggccagcgtgttcgacgcggacggctactaccggaccggagacgtcgtg
gccgaggtcgctccggaccggctggtgtacgtggaccgccgcaacaacgtgctgaagcttgcccagggcga
gttcgtgaccgtcgccaagctggaggcggtgttcggcaacagcccgctggtgcgccagatctacgtctacg
gcaacagcgcgcatccctacctgttggccgtggtggtgccaacggaagaagcgtcggcgggcactgacata
gcggccttgaagccgctgatcgccgactcgctgcagaccgtcgccaaagaggccggcctgcagtcctacga
ggtgccgcgcgacttcctcatcgagacaacaccattcacgctggagaacggtctgctcaccggtatccgca
agctggcgtggccgaagctgaggcagcattacggcgaacggctggagcagctctacacggagctggccgcg
agccaggccaacgagttgagcgagctgcggcgcagcggggcccatgcgccggtgctggaaacggtgagccg
ggcggcgggcgcgctgctggggcggcgagcaccgccttgtcacccgacgcgcacttcaccgatctgggtg
gagactcgttgtcggcgttgacattcggcaacctgctgcgggagatcttcgacgttgacgtaccggtgggt
gtgatcgtcagcccggccagcgacctggcggcgatcgccgcttacatcgagggcgagcggcagggcagcaa
gcgacccacgttcgccgtgattcacggtcgggacgcgctagaggtgcatgcgagtgacctcaccctggaca
agttcatcgacgcatccaccctggcagccgcaccggtactgccgcctccgagcgccgcggtgcgcaccgtc
ctgttgaccggcgcgaccggctttttgggccgctacctggcgctggactggctggagcgcatggacctggt
cgacggcaaggtgatcgccctggtgcgggcgaagtcggacgacgatgcccgggcacgcctggacaagacgt
tcgacagcggagaccccgagctgctgacccactaccggcggctggcgaccgaccacttggaggtcatcgcc
ggcgacaagggcgaggccaacctcgggctggatcagctgacctggcagcggctggccgacaccgtcgacct
gatcgtcgacccggccgcgttggtcaaccacgtgctgccctacagcgagctgttcggccccaacgcgctgg
gcaccgccgaattgatccggatagcgctgaccggcaagctcaagcccctacacctacgtctcgaccatcggg
gtgggcgaccagatcgagccgggcaagttcaccgaggacgccgacatccggcacatcagcgcgacccggaa
gatcaacgacagttacgccaacggctacggcaacagcaagtgggccggcgaggtgctactgcgcgaggccc
acgacctgtgcgggctgccggtcgcggtgttccgctgcgacatgatcctggccgacaccacgtgggcgggt
cagctcaacgtgccggacatgttcacccggatgatgctgagcctggtggccaccggcattgcacccggttc

FIG. 8S

```
gttctacgagctggacgccgacggcaaccggcagcgtgcccactacgacggcttgccggtcgagttcatcg
ccgaggcgatcgcgacgctgggcgcccgggacgggaaggggtttccagacctaccacgtgatgaaccccta c
gacgacggcatcgggatggaccggttcgtcgactggctcgtcgacgccggatgcgccatccaccgcatcga
cgactacggcgactggctgcgacgattcgagaccgcgctgcgcggcctgcccgaaaagcagcgtcacgcgt
cactactgccgttgctgcacaactaccagaagccggcgccgccgctgcgcgggtcgatggctccgaccgac
cggttccgggcggccgtgcaggacgcgaaagtgggcccggacaaggacatcccgcacatctcgccgcagat
catcgcgaagtacctcagtgatctgcgcttgctcgggctcctctga
```

Amino acid sequence (SEQ ID NO:38)

```
>gi|240173202|ref|ZP_04751860.1| FadD9 [Mycobacterium kansasii ATCC
12478]
MSTTTRDERLERRIDTLIHDDAQFAAAKPDPAIAAALEKPGLSLPEIIQTALQGYADRPALGQRAVEFVT
DTQTGRTSVRLLTRFETITYRQLGDRVGALARALTHDSVHAGDRVCVLGFNSLDYTTIDMALAKVGAVSV
PLQTSAAVTQLQPIVAETEPTMMAASVNQLSDAVDVLLSGHLPAKLVVFDYHPEVDDQREALDTARERLA
DTAVVVQTLKDVLDHGATLAAGSVAEPLAASGDNDSLALLIYTSGSTGAPKGAMYRQSNVGKMWRRSSKN
WFGPTAASITLNFMPMSHIMGRGVLYGTLGNGGTAYFAARSDLSTLLEDLRLVRPTELNFVPRIWETLYG
EYQRAVDQRSVDPGEPAAREAVEAQVMAEQRQDLLGGRYIFAMTGSAPMSPELRNWVEALLEIPLLDGYG
STEAGMVMFDGEIQRPPVIDYKLVDVPDLGYFSTDQPYPRGELLLKTENMFPGYYKRPEVTASVFDADGY
YRTGDVVAEVAPDRLVYVDRRNNVLKLAQGEFVTVAKLEAVFGNSPLVRQIYVYGNSAHPYLLAVVVPTE
EASAGTDIAALKPLIADSLQTVAKEAGLQSYEVPRDFLIETTPFTLENGLLTGIRKLAWPKLRQHYGERL
EQLYTELAASQANELSELRRSGAHAPVLETVSRAAGALLGAASTALSPDAHFTDLGGDSLSALTFGNLLR
EIFDVDVPVGVIVSPASDLAAIAAYIEGERQGSKRPTFAVIHGRDALEVHASDLTLDKFIDASTLAAAPV
LPPPSAAVRTVLLTGATGFLGRYLALDWLERMDLVDGKVIALVRAKSDDDARARLDKTFDSGDPELLTHY
RRLATDHLEVIAGDKGEANLGLDQLTWQRLADTVDLIVDPAALVNHVLPYSELFGPNALGTAELIRIALT
GKLKPYTYVSTIGVGDQIEPGKFTEDADIRHISATRKINDSYANGYGNSKWAGEVLLREAHDLCGLPVAV
FRCDMILADTTWAGQLNVPDMFTRMMLSLVATGIAPGSFYELDADGNRQRAHYDGLPVEFIAEAIATLGA
RDGKGFQTYHVMNPYDDGIGMDRFVDWLVDAGCAIHRIDDYGDWLRRFETALRGLPEKQRHASLLPLLHN
YQKPAPPLRGSMAPTDRFRAAVQDAKVGPDKDIPHISPQIIAKYLSDLRLLGLL
```

YP 978699.1

Nucleotide sequence (SEQ ID NO:39)

```
>uniprot|A1KLT8|A1KLT8_MYCBP Probable fatty-acid-CoA ligase fadD9

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
```

FIG. 8T

```
ATCACGCTGAACTTCATGCCGATGAGCCACGTCGGGGGCCGTCAGGTGCTCTACGGGACG
CTTTCCAACGGCGGTACCGCCTACTACGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTG
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCACGGAAGTGCAC
GCCAGCGACCTCACGCTGGACAAGTTCATCGACGCTGCCACCCTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCCGCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA
```

Amino acid sequence (SEQ ID NO:40)

>uniprot|A1KLT8|A1KLT8_MYCBP Probable fatty-acid-CoA ligase fadD9

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV

FIG. 8U

EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYYVAKSDLSTLFEDLALVRFTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL

ZP_05227804

Nucleotide sequence (SEQ ID NO:41)

>gi|163719878:4480-7968 Mycobacterium intracellulare ATCC 13950
NZ_ABIN01000296, whole genome shotgun sequence TTGGCCGCGACCGACGAACAGTTCCGCAACGCCCAACCCGATCTGTCGCTGCAGCAGGCGGCGCGCCAAC
CGGGCCTGCGCCTGCCCCAGATTCTGGAGCTGTTCGTCGAGGGCTACGCCGATCGGCCCGCGGTGGGCTG
GCGGGCCAGGACACTGAGCACCGACCCCGCGACCGGGCGTACCACCACGCGACTGCTCCCCGCTTCGAC
ACCATGACCTACCGCGAGCTGTGGGCCGATGTGCGCGCGATCGCCGCCGCGTGGCGGCACGACGCCGCGA
ACCCCGTGTCGCCCGGGGACTTCGTCGCGACGGTCGGTTTCGCCAGCGCCGAATATCTGACCCTCGACCT
GGTCTGCGGCTACCTCGGGCTGGTTGCCGTTCCGCTGCAACACAATACGACCCCCTCACGGCTGCGACCG
ATCGTCGACGAGGTCGAGCCGTCGATACTGGCCGCCGGCGTCGGTTATCTCGACCTCGCGGTCGAGGCGG
CGTCGGGCAGCTCGTCGTTGCGGCGGCTCGTGGTCTTCGATTACCAGCCCGAGGTCGACGAGCAACGCGA
GGCGCTGCAGCGCGCCCAGGCGACGCTGGCGGCCGCCGGCGCGGCGGTGACCATCGAGACCCTCGACGAA
ATCATCGAACGCGGACGCGCCCTGCCGCCCGAGCCCATGTACACCGGTGATACCGATCAGCGGCTGGCGA
TGATCATGTACACCTCGGGCAGCACCGGGTTACCCAAGGGCGCCATGTACACCGAGCAGATGCTGGCCAA
GGTGTGGACCAACGAGCTGATGCCCGACTTCGCGGACACACCCGTGTTCAACGTCAACTTCATGCCGCTG
AATCACCTCGGTGGCCGGATACCGCTGTCGACCGCGTTCCAGGCCGGCGGCACCAGCTATTTCGTGCCGG
AAAGCGACCTGTCCACGTTGTTCGACGACTGGAACCTGGTGCGCCCCACCGAGATGGGCCTGGTACCCCG
GGTGGCGGAAATGCTCTACCAGCGCTACCAGAGCGCCGTCGACCGACTCGTGGCTTCGGGCGCCGACGCC
GGCTCCGCCGAGGCCCGGGCGCGGGCCGAGCTGCGTGAGCATGTCCTCGGCGGGCGCATCGTGACCGCCT
TCTGCGGGACGGCGCCGCTGGCCGCGGAGATGCGGGCCTTCGTCGAAACCTGTTTGGACGTCACGTTCT
CGACGGCTACGGGCTGACCGAGGTCGGCATGGTGACCAAGGACGGGCGCATGACCCGTCCCCGGTGCTC
GACTACAAGCTCATCGACGTTCCCGAACTCGGCTATTTCCACACCGACAAGCCTTATCCGCGTGGCGAAT
TGCTGGTGAAGTCGCTGACCGCGACGCCGGGCTACTTCAAACGACCGGACGTCACCGCCAACGCGTTCGA
TCCCGACGGCTACTACCGGACCGGCGATGTGATGGCCGAGCTCGAGCCGGACCGGCTGGCCTACGTCGAC
CGCCGCAACAACGTGTTGAAGTTGGCGCAGGGCGAGTTCGTCGCCGTCGCCCGCCTGGAGGCCGTCTTCG
CCAGCGCGCCGCTGATCCGCCAGATCTTCGTATACGGCAACAGCGAACGCCCCTATCTGCTGGCCGTCGT
CGTGCCGACGGCCGACGCCGCGGAGCGATTCACCGGAGATCCCGAGGGCCTCAAGGCCGCCGTCGCCGAA
TCCCTGCGCCAGTCGGCGCAACTCGCCGAACTGCAGTCCTACGAGGTGCCCGTCGACTTCGTCGTCGAGA

FIG. 8V

```
CCGAGCCGTTCAGCGAGGACAACGGCCTGCTCTCGGGCGTGGGCAAGCTGCTGCGGCCGAAGCTCAAGGA
GCGCTACGCCGACCGGCTCGAACAGCTCTACGCCGAGCTGGCCGAAAACCGCGTGACCGAGTTGCGTGCG
CTGCGCGAGGGGCGGACAAACACCCCGTCGTCTTCACCCTCACCCGGGCCGCCGAGGCGCTACTGGGTG
TGGCCGGCGGCCCGCCCGCCCCGACGCACTGTTCATCGAACTCGGCGGCGATTCCCTGTCGGCGCTGAC
CTTCTCCAACCTGCTGCGCGACATCTTCGACGTCGACGTGCCGGTGGGAATGATCACCGGGCCGCGACC
GACCTGGGCCAGCTCGCGGAATACGTTGAATCCGAACGCAAATCGGGATCACGCCGGCCCACATTCGCGA
CGGTGCACGGACGCGGCGCCGCCGAGGTCCGCGCCGCGGAGCTCACCCTCGACAAGTTCATCGACGCGAC
GACCTTGGCCGCCGCACCGAACCTGCCGCGCGCGACCGGCACACCCCACACGGTCCTGCTGACCGGCGCC
AACGGCTACCTCGGCCGCTTCCTGGCCCTCGAATGGCTCGAGCGCCTCGCCGAGACCGGCGGGAAGCTCG
TCTCCATCGTCCGCGCGACGGACACCGCGGCGGCCGTCAAACGGCTGGAGGCCGTTTTCGACAGCGGGGA
TCCGCAGTTGCTGGAGCGGTTCCGGACGCTGGCCGCCGAGCACCTGGAAGTCATCGTCGGCGACATCGGT
GAGCCCAATCTCGGCCTGGACCAAGCGACTTGGCAGCGCCTGGCCCAGAGCGTGGATCTGATCGTCCACC
CGGCCGCGTTGGTCAACCACGTGCTGCCGTACGACCAACTGTTCGGTCCGAACGTCGTCGGCACCGCCGA
GTTGATCCGCCTGGCGATCACGACGCGCATCAAGCCCGTCACCTATCTGTCGACCGTCGCCGTGGCGATG
ACGGTCGATCCCGGCGAGTTCGCCGAAGACGGCGACATCCGCGCGGTCAGCGCGGTACGCCCGATCGACG
ACAGCTACGCGAACGGGTACGCGAACAGCAAGTGGGCCGGTGAGGTGTTGCTGCGTGAGGCGCACGACCT
GTGCGGGTTGCCGGTCGCCGTCTTCCGCTCCGACATGATCCTCGCGCACAGCCGGTATGCCGGGCAGCTG
AACGTGCCAGATGCCTTCACCCGCTTGATGTTCAGCCTGCTGACCACCGGCATCGCGCCGACCACGTTCT
ACCGGACCGACGAACACGGAAACCGAGCCGTGGCCCACTACGACGGGCTGCCCGCCGACTTCGTGGCCGA
AGCGGTCACCACGCTCGGCGAACAGATGGCGGCCGAGGAATCCGGCGGGTACCGCTCCTATGACGTGATG
AACCCACACGACGACGGCGTCTCCCTGGACGTGTTCGTCGACTGGCTGATCGCCGCCGGACACGACATCC
GGCGCATCGAGGACTATGACGAATGGCTGGGCCGCTTCACCACGGCGCTTCGCGCGTTACCGGACAAGCA
GCGCCAGCATTCGGTGTTGCCGCTGCTGGACGCCTACCGGGAACCCGCGACGCCACTGCGGGGAGCGCCG
GCCCCCACCGACGTCTTCCGCCACGCGGTGCGGACGGCCAAAATCGGTGCGGACGAGGACATTCCGCACC
TGTCGGCGGCGTTGATCGACAAGTACGTCGCCGACCTACGCCTGCTGGGCTTGGTGTAG
```

Amino acid sequence (SEQ ID NO:42)

>gi|254822803|ref|ZP_05227804.1| putative long-chain fatty-acid--CoA ligase [Mycobacterium intracellulare ATCC 13950]

```
MAATDEQFRNAQPDLSLQQAARQPGLRLPQILELFVEGYADRPAVGWRARTLSTDPATGRTTTRLLPRFD
TMTYRELWADVRAIAAAWRHDAANPVSPGDFVATVGFASAEYLTLDLVCGYLGLVAVPLQHNTTPSRLRP
IVDEVEPSILAAGVGYLDLAVEAASGSSSLRRLVVFDYQPEVDEQREALQRAQATLAAAGAAVTIETLDE
IIERGRALPPEPMYTGDTDQRLAMIMYTSGSTGLPKGAMYTEQMLAKVWTNELMPDFADTPVFNVNFMPL
NHLGGRIPLSTAFQAGGTSYFVPESDLSTLFDDWNLVRPTEMGLVPRVAEMLYQRYQSAVDRLVASGADA
GSAEARARAELREHVLGGRIVTAFCGTAPLAAEMRAFVETCLDVHVLDGYGLTEVGMVTKDGRMTRPPVL
DYKLIDVPELGYFHTDKPYPRGELLVKSLTATPGYFKRPDVTANAFDPDGYYRTGDVMAELEPDRLAYVD
RRNNVLKLAQGEFVAVARLEAVFASAPLIRQIFVYGNSERPYLLAVVVPTADAAERFTGDPEGLKAAVAE
SLRQSAQLAELQSYEVPVDFVVETEPFSEDNGLLSGVGKLLRPKLKERYADRLEQLYAELAENRVTELRA
LREGADKHPVVFTLTRAAEALLGVAGGPPAPDALFIELGGDSLSALTFSNLLRDIFDVDVPVGMITGPAT
DLGQLAEYVESERKSGSRRPTFATVHGRGAAEVRAAELTLDKFIDATTLAAAPNLPRATGTPHTVLLTGA
NGYLGRFLALEWLERLAETGGKLVSIVRATDTAAAVKRLEAVFDSGDPQLLERFRTLAAEHLEVIVGDIG
EPNLGLDQATWQRLAQSVDLIVIHPAALVNHVLPYDQLFGPNVVGTAELIRLAITTRIKPVTYLSTVAVAM
TVDPGEFAEDGDIRAVSAVRPIDDSYANGYANSKWAGEVLLREAHDLCGLPVAVFRSDMILAHSRYAGQL
NVPDAFTRLMFSLLTTGIAPTTFYRTDEHGNRAVAHYDGLPADFVAEAVTTLGEQMAAEESGGYRSYDVM
NPHDDGVSLDVFVDWLIAAGHDIRRIEDYDEWLGRFTTALRALPDKQRQHSVLPLLDAYREPATPLRGAP
APTDVFRHAVRTAKIGADEDIPHLSAALIDKYVADLRLLGLV
```

Nucleotide sequence (SEQ ID NO:43)

>uniprot|A1QUM2|A1QUM2_MYCTF Fatty-acid-CoA ligase fadD9

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACG
CTTTCCAACGGCGGTACCGCCTACTTCGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTG
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTACGCTGGACAAGTTCATCGACGCTGCCACCCTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCCGCCG
GAGGCGTTCACCGAGGACGCCGACATCCGGGCCATCAGCCCGACCCGCAGGATCGACGAC

FIG. 8X

```
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACGCCTCGCTGCTGCCCTTGCTGCACAACTACGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA
```

Amino acid sequence (SEQ ID NO:44)

>uniprot|A1QUM2|A1QUM2_MYCTF Fatty-acid-CoA ligase fadD9

```
MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL
```

YP 953393.1

Nucleotide sequence (SEQ ID NO:45)

>uniprot|A1T887|A1T887_MYCVP Thioester reductase domain

```
ATGTCTACTGATACCCGCGAAGACCGCCTTGCCCGCCGCATCGCCGATCTGTACGCCACC
GACCCGCAGTTTGCCGCCGCAGCACCCGACGACGCCATCTCCCACGCCATCGATCAACCA
GGGACGCACCTGCCCGTCATCGTGCAGACCGTCCTCGACGGATACGCCGAGCGGCCCGCG
CTCGGACAGCGCGCGGTCCGTTTCGTCACCGACCCCGCCACGGGCAGAACCACCACCGAG
CTGCTCCCCCGCTTCGAGACCATCACCTACGCCGAGTTGTCACGCCGCATCCACGCGGTC
```

FIG. 8Y

```
ACCGCCGCGCTGACCGATGTGCATCCGGGCGACCGCGTGGCGGTGCTGGGCTTCACCAGC
ATCGACTACACCACCGTCGACATGGCTTTGGCGATGCTGGGCGCGGTGGCGGTACCACTT
CAGACCAGCGCGCCGGCCACCACCGTCCGGCCGATCGTCGCCGAGACCGAACCGGTGGTC
ATCGCATCGTCGGTCGATGCCCTCACCGACGCCGTCGGCCTGGCTCTCGACGCTCCCACC
GTGACCCGCCTTGTGGTCTTCGATCATCGCGCCGGGGTCGACGATCATCGCGACGCCCTC
ATCTCCGCGAGCGACCGGTTGCGCGCCGCCAACTCGCCGATCGAGGTCGAGACCATTACC
GACATCGTCGCTCGGGGTTCGAAACTGCCTGTACGCGCGCAATTCTCGGCCGACGGTGAC
GCGCTGAGCCTGCTGATCTACACCTCCGGCAGCACCGGCGCACCCAAGGGTGCGATGTAC
CCCCAACACCTGGTCGCCAACTCATGGCGGCGGTTGGCCCGGTCCTTCTGGGGCGACCTG
GGGGTCTTCCCGGCAATCACGCTGAACTTCATGCCGATGAGCCACGTGATGGGCCGCGGA
CTGCTCTACGGCACGCTGGACGCCGGCGGCACCGCGTATTTCGCGGCCAGGAGCGATCTG
TCGACGTTCCTGGAGGATCTCGCCCTGGTGCGCCCGACGCAGCTGAGCTTCGTGCCGCGG
ATCTGGGACACCATCCACGCCGAGGTGTCCCAGGAACTCGAGCGCCGGCCGTCGGATGCG
ACCGAGGTGATCGCCGATCTGCGGCGGAGCCTGCTGGGCGGCCGCTACGTCACGGCGATG
ACGGGCTCCGCGCCGCTGTCACCGGAGATGCGGGCCTTCGTCGAGAACCTGCTCGACGTG
CACCTGATCGACGGGTACGGCTCGACCGAGGCCGGCGCGGTGTTCGTCGACGGCCGGGTC
CAACGCCCGCCGGTCATCGATTACAAGCTCGTCGACGTCGCCGACCTCGGCTACTTCTCC
ACCGACCGCCCCATCCGCGCGGCGAGCTTCTCGTCAAATCCGAGACGCTGTTTCCCGGC
TACTACAAACGCCCCGACGTCACCGCCGAGATGTTCGACGAAGACGGCTACTACCGCACC
GGCGACATCGTCGCCGAGACCGGGGCCGACCAGCTGACCTATCTGGACCGCCGCAACAAC
GTCCTCAAACTGTCGCAGGGCGAATTCGTCACCGTCTCCCGACTGGAGGCAGTGTTCGGC
AACAGCCCGCTGGTCCGCCAGATCTACGTCTACGGCAACAGCGCCCGCCCCTACCTGCTG
GCTGTGGTCGTGCCCACCGAAGCCGCGCTGGCCGGTGCTGACGCCAAAGCCGCTGTGGCC
GAGTCACTTCAGGATGTCGCCAAGGCGACCGGGCTGCAGTCCTACGAGATCCCCCGCGAT
TTCCTTCTCGAGACGACGCCGTTCACGCTGGAGAACGGCTTGCTGACCGGCATCCGAAAA
CTGGCCCGCCCCAGACTCAGAGAGCGTTACGGCGAACAGCTCGAGGCCCTCTACACCATG
CTGTCCGAAGAGCAGGCCGACGAGCTGCGGGAGCTGCGCCGCTCCGGCGGAGAGCGTCCG
GCGCTGGAAACCGTCGGACGCGCCGCCGGGGCGCTGCTCGGCACCACCGCAGGCGAGCTG
GAGCCGAGCGCCCACTTCACAGATCTGGGCGGGGATTCGCTGTCGGCGTTGACCTTCGCC
AACCTGCTGCGCGACATCTTCGACGTCGACGTCCCCGTCGGTGTGATCGTCAGCCCGGCC
ACCGATCTGCAGGCCCTTGCCGACTACGTCGAGTCCGCCCGCCGGCACGGGTCGGTGCGG
CCCACTTTCGAATCGGTGCACGGGCATTCGGGACGACCCGGGACCGAGGTGCATGCCCGC
GATCTGACGTTGGACGAATTCGTCGACGCCGCGACCCTGGCGCACGCGCCGACGTTGCCC
GGACCGCGCGCCGAGGTCCGCACCGTCCTGCTGACCGGGGCGACCGGCTTCCTCGGCCGG
TATCTCGCTCTCGAATGGCTTGAGCGGATGGCGCTGGTCGGCGGCAAGCTGATCTGCCTG
GTCCGCGCCAAAGACGATGCGGCAGCGCGGGTTCGGCTGGACAGCACGTTCGACAGCGGG
GACCCGGAGCTGCTGCGGCACTACCGACGGCTGGCAGCCGACCATCTCGAAGTGATCGCC
GGCGACAAGGCCGACGCCGATCTCGGACTCGACGCGCGGACGTGGCAGCGGCTCGCGGAC
ACCGTCGATCTGATCGTCGATCCCGCCGCCCTGGTCAACCACGTCCTGCCGTACCGCCAA
CTGTTCGCCCCGAACGTGCTCGGCACCGCCGAACTGCTCCGCATCGCGCTGACAACGAGG
ATGAAGCCGTTCGTGTACGTGTCGACGATCGGCGTCGGCGCCGGTATCGAACCCGCGAGG
TTCACCGAGGACGCCGACATCAGGCAGATCAGCGCGACGCGCAGAATCGACGACAGCTAC
GCCAACGGCTACGGCAACAGCAAGTGGGCCGGCGAGGTGCTGCTGCGCGAGGCGCACGAT
CTGTGCGGCCTGCCCGTTTCGGTGTTCCGCTGCGACATGATCCTGGCCGACACCACCTAC
GCCGGTCAGCTGAACCTGCCGGACATGTTCACCCGCCTGATCTTCAGCCTGGTCGCCACC
GGCGTCGCGCCCGAGTCGTTCTACCACCTCGCCACCGACGGCACCCGGCAACGGGCCCAC
TATGACGGGCTACCGGTGGAGTTCATCGCCGAAGCGATCTCGACCCTCGGCTCTGACGTC
GCCTCCGGGTTCCGGACGTATCACGTGATGAATCCCCACGACGACGGGATAGGCCTCGAC
GAGTACGTGGACTGGCTCATCGACGCAGGCCATCCGATTCGACGCGTCGGCGACTACCCG
ACGTGGCTGCAACGGTTCACGGTGGCGATCACCGCGCTGCCGGAACGGCAGCGGCAGGCC
TCACTGTTGCCGCTGCTGCACAACTACCAGCACCCGGAGACGCCGATCCGCGGCTCCATC
GCACCGACAGACAGATTCCGTGAAGCGGTCCAGGACGCCAAAATCGGTCCGGACAAAGAC
ATTCCACACGTGACACCGCAGATCGTCATCAAGTACGTCACCGACCTGCAGCGACTCGGA
CTGCTCTAA
```

FIG. 8Z

Amino acid sequence (SEQ ID NO:46)

\>uniprot|A1T887|A1T887_MYCVP Thioester reductase domain

MSTDTREDRLARRIADLYATDPQFAAAAPDDAISHAIDQPGTHLPVIVQT
VLDGYAERPALGQRAVRFVTDPATGRTTTELLPRFETITYAELSRRIHAV
TAALTDVHPGDRVAVLGFTSIDYTTVDMALAMLGAVAVPLQTSAPATTVR
PIVAETEPVVIASSVDALTDAVGLALDAPTVTRLVVFDHRAGVDDHRDAL
ISASDRLRAANSPIEVETITDIVARGSKLPVRAQFSADGDALSLLIYTSG
STGAPKGAMYPQHLVANSWRRLARSFWGDLGVFPAITLNFMPMSHVMGRG
LLYGTLDAGGTAYFAARSDLSTFLEDLALVRPTQLSFVPRIWDTIHAEVS
QELERRPSDATEVIADLRRSLLGGRYVTAMTGSAPLSPEMRAFVENLLDV
HLIDGYGSTEAGAVFVDGRVQRPPVIDYKLVDVADLGYFSTDRPHPRGEL
LVKSETLFPGYYKRPDVTAEMFDEDGYYRTGDIVAETGADQLTYLDRRNN
VLKLSQGEFVTVSRLEAVFGNSPLVRQIYVYGNSARPYLLAVVVPTEAAL
AGADAKAAVAESLQDVAKATGLQSYEIPRDFLLETTPFTLENGLLTGIRK
LARPRLRERYGEQLEALYTMLSEEQADELRELRRSGGERPALETVGRAAG
ALLGTTAGELEPSAHFTDLGGDSLSALTFANLLRDIFDVDVPVGVIVSPA
TDLQALADYVESARRHGSVRPTFESVHGHSGRPGTEVHARDLTLDEFVDA
ATLAHAPTLPGPRAEVRTVLLTGATGFLGRYLALEWLERMALVGGKLICL
VRAKDDAAARVRLDSTFDSGDPELLRHYRRLAADHLEVIAGDKADADLGL
DARTWQRLADTVDLIVDPAALVNHVLPYRQLFAPNVLGTAELLRIALTTR
MKPFVYVSTIGVGAGIEPARFTEDADIRQISATRRIDDSYANGYGNSKWA
GEVLLREAHDLCGLPVSVFRCDMILADTTYAGQLNLPDMFTRLIFSLVAT
GVAPESFYHLATDGTRQRAHYDGLPVEFIAEAISTLGSDVASGFRTYHVM
NPHDDGIGLDEYVDWLIDAGHPIRRVGDYPTWLQRFTVAITALPERQRQA
SLLPLLHNYQHPETPIRGSIAPTDRFREAVQDAKIGPDKDIPHVTPQIVI
KYVTDLQRLGLL

YP 938306.1

Nucleotide sequence (SEQ ID NO:47)

\>uniprot|A1UFA8|A1UFA8_MYCSK Thioester reductase domain

ATGTCCACCGAGACCCGTGAAGCGCGCCTGCAGCAGCGCATCGCGCATCTGTTCACCACC
GACCCGCAGTTCGCCGCCGCCCGGCCCGACCCCCGGATCAGCGATGCCGTCGACCGCGAT
GACACGCGGCTGACCGCCATCGTCTCCGCGGTCATGTCGGGGTACGCCGACCGGCCGGCA
CTCGGGCAGCGCGCCGCCGAATTCGTCACCGACCCGCAGACCGGCCGCACCACGATGGAG
CTGCTCCCCGCTTCGACACCATCACCTACGGGAGCTGCTCGACCGCGTCCGGGCGCTC
ACCAACGCGTGGCACGCCGACGGGGTGCGCCCCGGCGACCGTGTCGCAATCCTCGGATTC
ACCGGCATCGACTACACCGTGGTCGACCTCGCCCTGATCCAGCTCGGCGCGGTCGCGGTG
CCGCTGCAGACCAGCGCCGCCGTGGAGGCGTTGCGCCCGATCGTGGCCGAGACCGAACCG
ATGCTCATCGCCACCGGCGTCGATCATGTCGACGCCGCCGCGGAACTCGCACTCACCGGC
CACCGTCCGTCCCGGGTGGTGGTCTTCGACCACCGCGAGCAGGTCGACGACGAACGCGAC
GCGGTGCGGGCCGCGACGGCCAGGCTGGGAGACGCCGTCCCGTCGAGACACTCGCCGAG
GTGTTGCGGCGGGGCGCCATCTGCCCGCCGTGGCGCCGCACGTGTTCGACGAGGCCGAT
CCACTGCGGCTGCTGATCTACACTTCCGGCAGCGCCGGCGCCCCCAAGGGCGCGATGTAT
CCCGAGAGCAAGGTCGCCGGCATGTGGCGCGCGTCGGCCAAGGCCGCCTGGAACAACGAT
CAGACAGCGATTCCGTCGATCACCCTGAACTTCCTGCCGATGAGCCACGTCATGGGTCGC
GGCCTGCTGTGCGGCACGCTCAGCACCGGTGGCACCGCGTATTTCGCCGCCCGCAGCGAT
CTGTCGACGCTGCTCGAGGACCTGCGCCTGGTACGGCCCACCCAACTCAGCTTCGTGCCG

FIG. 8AA

```
CGGATCTGGGACATGCTCTTCCAGGAGTTCGTCGGCGAGGTCGACCGGCGGGTGAACGAC
GGTGCGGACCGCCCCACCGCGGAGGCCGACGTGCTGGCCGTACAGCGTCACGAGCTGCTC
GGTGGCCGGTTCGTCACCGCGATGACCGGTTCGGCGCCCATCTCCCTCGAGATGAAGACA
TGGGTGGAGACCCTGCTCGACATGCACCTGGTCGAGGGTTACGGCTCGACGGAGGCCGGC
GCGGTGTTCGTCGACGGCCACATCCAGCGCCCACCGGTGCTCGACTACAAACTCGTCGAC
GTCCCCGACCTCGGCTACTTCAGCACCGACCGGCCGCACCCGCGCGGTGAGCTGCTGGTC
CGCTCCACGCAGCTATTCCCCGGCTACTACAAACGTCCCGACGTCACCGCCGAGGTGTTC
GACGACGACGGCTTCTACCGCACGGGCGACATCGTCGCCGAGGTCGGCCCCGATCAGGTG
CAGTACCTCGACCGCCGCAACAACGTGCTCAAACTCGCCCAGGGTGAGTTCGTCACCATC
TCCAAACTCGAGGCGGTCTTCGCCGGCAGCGCCCTGGTCCGCCAGATCTACGTGTACGGC
AACAGTGCGCGCTCCTACCTGCTGGCCGTCGTCGTGCCGACCGACGATGCGGTGGCCCGG
CACGACCCGGCATCGCTCAAGACCGCGATCAGCGCCTCGCTGCAGCAGGCCGCGAAGACC
GCCGGTCTGCAGTCCTACGAGCTGCCGCGTGACTTCCTCGTCGAGACTCAACCGTTCACG
CTGGAGAACGGACTACTGACCGGCATCCGCAAGCTGGCGCGCCCGAAACTCAAGGCGCGC
TACGGCGATCGGCTCGAGGCGCTCTACGTCGAACTGGTCGAAGGACAGGCAGGCGAATTG
CGCACCCTGCGCCGGGACGGCGCGAAGCGTCCGGTGGCCGAGACGGTCGGCCGCGCCGCG
GCCGCGCTGCTCGGCGCCGCCGCCGCCGACGTGCGCCCCGACGCGCACTTCACCGACCTC
GGCGGAGACTCGTTGTCGGCGTTGACCTTCGGCAATCTGCTGCAGGAGATCTTCGGCGTC
GACGTCCCGGTCGGGGTGATCGTCAGCCCGGCGGCCGACCTGGCGTCGATCGCGGCGTAC
ATCGAGGCCGAACAGGCCTCGACCGGTAAGCGGCCGACCTACGCGTCGGTGCACGGGCGC
GACGCCGAACAGGTACACGCGCGCGACCTCACCCTGGACAAGTTCATCGACGCCGAAACA
CTCTCCGCTGCAACAGAACTGCCCGGCCCGAGCGGTGAGGTGCGCACCGTGCTGCTGACC
GGGGCCACCGGATTCCTCGGCCGCTACCTGGCGCTGGACTGGCTCGAACGGATGGCCCTG
GTCGACGGCAAGGTCATCTGCCTGGTCCGCGCGAAGGACGATGCGGCCGCCCGCAAACGC
CTCGACGACACCTTCGACAGCGGCGATCCGAAGCTGCTGGCGCACTACCGCAAGCTGGCC
GCCGACCACCTCGAAGTGCTGGCCGGCGACAAGGGTGAGGCGGATCTCGGGCTGCCGCAT
CCTGTCTGGCAGCGCCTGGCCGACACCGTCGACCTCATCGTCGACCCGGCCGCCCTGGTC
AACCACGTACTGCCGTACAGCCAGCTGTTCGGCCCAACGCGCTGGGCACTGCCGAGCTG
ATCCGGCTTGCGCTCACCACCCGCATCAAACCGTTCACCTACGTGTCGACGATCGGCGTC
GGCGCCGGTATCGAACCGGGCCGTTTCACCGAGGACGACGACATCCGGGTGATCAGCCCG
ACGCGGGCCGTCGACACCGGGTACGCCAACGGCTACGGCAACAGCAAGTGGGCCGGTGAG
GTGTTGTTGCGCGAGGCGCACGATCTGTGCGGGCTCCCCGTGGCGGTGTTCCGGTGCGAC
ATGATCCTGGCCGACACCACCTACGCCGGCCAGCTCAACCTGCCGGACATGTTCACCCGG
ATGATGCTGAGCCTGGTGACCACGGGTATCGCGCCGAAATCGTTCCACCCACTCGACGCA
AAGGGCCACCGGCAGAGCGCCCACTACGACGGGCTGCCGGTCGAGTTCGTCGCCGAATCG
ATCTCCGCGCTGGGAGCGCAGGCGGTCGACGAGGCGGGAACGGGTTTCGCCACCTACCAC
GTGATGAACCCCCACGACGACGGGATCGGCCTCGACGAATTCGTCGACTGGCTCGTCGAG
GCGGGGTATCGCATCGACCGCATCGACTACTACGCGGCCTGGCTGCAGCGGTTCGAAACC
GCCCTGCGGCGCTGCCCGAGCGCACTCGGCAGTACTCACTGCTCCCGCTGCTGCACAAC
TACCAGCGGCCTGCGCACCCGATCAACGGGGCGATGGCCCCGACCGACCGGTTCCGCGCT
GCGGTGCAGGAGGCAAAGCTCGGCCCGGACAAGGACATTCCCCACGTCACTCCAGCGGTG
ATCGTCAAGTACGCCACCGACCTGGAGCTGCTGGGCCTGATCTAG
```

Amino acid sequence (SEQ ID NO:48)

>uniprot|A1UFA8|A1UFA8_MYCSK Thioester reductase domain

```
MSTETREARLQQRIAHLFTTDPQFAAARPDPRISDAVDRDDTRLTAIVSA
VMSGYADRPALGQRAAEFVTDPQTGRTTMELLPRFDTITYRELLDRVRAL
TNAWHADGVRPGDRVAILGFTGIDYTVVDLALIQLGAVAVPLQTSAAVEA
LRPIVAETEPMLIATGVDHVDAAAELALTGHRPSRVVVFDHREQVDDERD
AVRAATARLGDAVPVETLAEVLRRGAHLPAVAPHVFDEADPLRLLIYTSG
SAGAPKGAMYPESKVAGMWRASAKAAWNNDQTAIPSITLNFLPMSHVMGR
GLLCGTLSTGGTAYFAARSDLSTLLEDLRLVRPTQLSFVPRIWDMLFQEF
```

FIG. 8BB

VGEVDRRVNDGADRPTAEADVLAVQRHELLGGRFVTAMTGSAPISLEMKT
WVETLLDMHLVEGYGSTEAGAVFVDGHIQRPPVLDYKLVDVPDLGYFSTD
RPHPRGELLVRSTQLFPGYYKRPDVTAEVFDDDGFYRTGDIVAEVGPDQV
QYLDRRNNVLKLAQGEFVTISKLEAVFAGSALVRQIYVYGNSARSYLLAV
VVPTDDAVARHDPASLKTAISASLQQAAKTAGLQSYELPRDFLVETQPFT
LENGLLTGIRKLARPKLKARYGDRLEALYVELVEGQAGELRTLRRDGAKR
PVAETVGRAAAALLGAAAADVRPDAHFTDLGGDSLSALTFGNLLQEIFGV
DVPVGVIVSPAADLASIAAYIEAEQASTGKRPTYASVHGRDAEQVHARDL
TLDKFIDAETLSAATELPGPSGEVRTVLLTGATGFLGRYLALDWLERMAL
VDGKVICLVRAKDDAAARKRLDDTFDSGDPKLLAHYRKLAADHLEVLAGD
KGEADLGLPHPVWQRLADTVDLIVDPAALVNHVLPYSQLFGPNALGTAEL
IRLALTTRIKPFTYVSTIGVGAGIEPGRFTEDDDIRVISPTRAVDTGYAN
GYGNSKWAGEVLLREAHDLCGLPVAVFRCDMILADTTYAGQLNLPDMFTR
MMLSLVTTGIAPKSFHPLDAKGHRQSAHYDGLPVEFVAESISALGAQAVD
EAGTGFATYHVMNPHDDGIGLDEFVDWLVEAGYRIDRIDYYAAWLQRFET
ALRALPERTRQYSLLPLLHNYQRPAHPINGAMAPTDRFRAAVQEAKLGPD
KDIPHVTPAVIVKYATDLELLGLI

ZP_05217435

Nucleotide sequence (SEQ ID NO:49)

>gi|222089526:2534-6055 Mycobacterium avium subsp. avium ATCC 25291
NZ_ACFI01000138, whole genome shotgun sequence ATGTCGACTGCCACCCATGACGAACGACTCGACCGTCGCGTCCACGAACTCATCGCCACCGACCCGCAAT
TCGCCGCCGCCCAACCCGACCCGGCGATCACCGCCGCCCTCGAACAGCCCGGGCTGCGGCTGCCGCAGAT
CATCCGCACCGTGCTCGACGGCTACGCCGACCGGCCGGCGCTGGGACAGCGCGTGGTGGAGTTCGTCACG
GACGCCAAGACCGGGCGCACGTCGGCGCAGCTGCTCCCCCGCTTCGAGACCATCACGTACGGCGAAGTGG
CGCAGCGTGTTTCGGCGCTGGGCCGCGCCCTGTCCGACGACGCGGTGCACCCCGGCGACCGGGTGTGCGT
GCTGGGCTTCAACAGCGTCGACTACGCCACCATCGACATGGCGCTGGGCGCCATCGGCGCCGTCTCGGTG
CCGCTGCAGACCAGCGCGGCAATCAGCTCGCTGCAGCCGATCGTGGCCGAGACCGAGCCCACCCTGATCG
CGTCCAGCGTGAACCAGCTGTCCGACGCGGTGCAGCTGATCACCGGCGCCGAGCAGGCGCCCACCCGGCT
GGTGGTGTTCGACTACCACCCGCAGGTCGACGACCAGCGCGAGGCCGTCCAGGACGCCGCGGCGCGGCTG
TCCAGCACCGGCGTGGCCGTCCAGACGCTGGCCGAGCTGCTGGAGCGCGGCAAGGACCTGCCCGCCGTCG
GGGAGCCGCCCGCCGACGAGGACTCGCTGGCCCTGCTGATCTACACCTCCGGGTCCACCGGCGCCCCCAA
GGGCGCGATGTACCCGCAGAGCAACGTCGGCAAGATGTGGCGCCGCGGCAGCAAGAACTGGTTCGGCGAG
AGCGCCGCGTCGATCACCCTGAACTTCATGCCGATGAGCCACGTGATGGGCCGAAGCATCCTCTACGGCA
CGCTGGGCAACGGCGGCACCGCCTACTTCGCCGCCCGCAGCGACCTGTCCACCCTGCTCGAGGACCTCGA
GCTGGTGCGGCCCACCGAGCTCAACTTCGTCCCGCGGATCTGGGAGACGCTGTACGGCGAATTCCAGCGT
CAGGTCGAGCGGCGGCTCTCCGAGTCCGGGGACGCCGGCGAACGTCGCGCCGTCGAGGCCGAGGTGCTGG
CCGAGCAGCGCCAGTACCTGCTGGGCGGGCGGTTCACCTTCGCGATGACGGGCTCGGCGCCCATCTCGCC
GGAGCTGCGCAACTGGGTCGAGTCGCTGCTCGAAATGCACCTGATGGACGGCTACGGCTCCACCGAGGCC
GGAATGGTGTTGTTCGACGGGGAGATTCAGCGCCCGCCGGTGATCGACTACAAGCTGGTCGACGTGCCGG
ACCTGGGCTACTTCAGCACCGACCGGCCGCATCCGCGCGGCGAGCTGCTGCTGCGCACCGAGAACATGTT
CCCGGGCTACTACAAGCGGGCCGAAACCACCGCGGGCGTCTTCGACGAGGACGGCTACTACCGCACCGGC
GACGTGTTCGCCGAGATCGCCCCGGACCGGCTGGTCTACGTCGACCGCCGCAACAACGTGCTCAAGCTGG
CGCAGGGCGAATTCGTCACGCTGGCCAAGCTGGAGGCGGTGTTCGGCAACAGCCCGCTGATCCGCCAGAT
CTACGTCTACGGCAACAGCGCCCAGCCCTACCTGCTGGCGGTCGTGGTGCCCACCGAGGAGGCGCTGGCC
TCGGGTGACCCCGAGACGCTCAAGCCCAAGATCGCCGACTCGCTGCAGCAGGTCGCCAAGGAGGCCGGCC
TGCAGTCCTACGAGGTGCCGCGCGACTTCATCATCGAGACCACCCCGTTCAGCCTGGAAAACGGTCTGCT
GACCGGGATCCGGAAGCTGGCGTGGCCGAAACTGAAGCAGCACTACGGGGAACGGCTGGAGCAGATGTAC
GCCGACCTGGCCGCCGGACAGGCCAACGAGCTGGCCGAGCTGCGCCGCAACGGTGCCCAGGCGCCGGTGC

FIG. 8CC

```
TGCAGACCGTGAGCCGCGCCGCGGGCGCCATGCTGGGTTCGGCCGCCTCCGACCTGTCCCCCGACGCCCA
CTTCACCGATCTGGGCGGAGACTCGTTGTCGGCGTTGACATTCGGCAACCTGCTGCGCGAGATCTTCGAC
GTCGACGTGCCGGTGGGCGTCATCGTCAGCCCGGCCAACGACCTGGCGGCCATCGCGAGCTACATCGAGG
CCGAGCGGCAGGGCAGCAAGCGCCCGACGTTCGCCTCGGTGCACGGCCGGGACGCGACCGTGGTGCGCGC
CGCCGACCTGACGCTGGACAAGTTCCTCGACGCCGAGACGCTGGCCGCCGCGCCGAACCTGCCCAAGCCG
GCCACCGAGGTGCGCACCGTGCTGCTGACCGGCGCCACCGGCTTCCTGGGCCGCTACCTGGCCCTGGAAT
GGCTGGAGCGGATGGACATGGTGGACGGCAAGGTCATCGCCCTGGTCCGGGCCCGCTCCGACGAGGAGGC
ACGCGCCCGGCTGGACAAGACCTTCGACAGCGGCGACCCGAAGCTGCTCGCGCACTACCAGCAGCTGGCC
GCCGATCACCTGGAGGTCATCGCCGGCGACAAGGGCGAGGCCAATCTGGGCCTGGGCCAAGACGTTTGGC
AACGACTGGCCGACACGGTCGACGTGATCGTCGACCCCGCCGCGCTGGTCAACCACGTGTTGCCGTACAG
CGAGCTGTTCGGGCCCAACGCCCTGGGCACCGCGGAGCTGATCCGGCTGGCGCTGACGTCCAAGCAGAAG
CCGTACACCTACGTGTCCACCATCGGCGTGGGCGACCAGATCGAGCCGGGCAAGTTCGTCGAGAACGCCG
ACATCCGGCAGATGAGCGCCACCCGGGCGATCAACGACAGCTACGCCAACGGCTACGGCAACAGCAAGTG
GGCCGGCGAGGTGCTGCTGCGCGAGGCGCACGACCTGTGCGGGCTGCCCGTCGCGGTGTTCCGCTGCGAC
ATGATCCTGGCCGACACCACGTATGCCGGGCAGCTCAACCTGCCGGACATGTTCACCCGGCTGATGCTGA
GCCTGGTGGCCACCGGGATCGCGCCCGGCTCGTTCTACGAGCTCGACGCCGACGGCAACCGGCAGCGGGC
GCACTACGACGGCCTGCCGGTCGAGTTCATCGCCGCGGCGATCTCGACGCTGGGTTCGCAGATCACCGAC
AGCGACACCGGCTTCCAGACCTACCACGTGATGAACCCCTACGATGACGGCATCGGTCTGGACGAGTACG
TCGATTGGCTGGTGGACGCCGGCTATTCGATCGAGCGGATTGCCGACTACTCCGAATGGCTGCGGCGGTT
CGAGACCCTCGCTGCGGGCCCTGCCGGACCGGCAGCGCCAGTACTCGCTGCTGCCGCTGCTGCACAACTAC
CGCACGCCGGAGAAGCCGATCAACGGGTCGATAGCTCCCACCGACGTGTTCCGGGCAGCGGTGCAGGAGG
CGAAAATCGGCCCCGACAAAGACATTCCGCACGTGTCGCCGCCGGTCATCGTCAAGTACATCACCGACCT
GCAGCTGCTCGGGCTGCTCTGA
```

Amino acid sequence (SEQ ID NO:50)
>gi|254775919|ref|ZP_05217435.1| FadD9 [Mycobacterium avium subsp.
avium ATCC 25291]

```
MSTATHDERLDRRVHELIATDPQFAAAQPDPAITAALEQPGLRLPQIIRTVLDGYADRPALGQRVVEFVT
DAKTGRTSAQLLPRFETITYGEVAQRVSALGRALSDDAVHPGDRVCVLGFNSVDYATIDMALGAIGAVSV
PLQTSAAISSLQPIVAETEPTLIASSVNQLSDAVQLITGAEQAPTRLVVFDYHPQVDDQREAVQDAAARL
SSTGVAVQTLAELLERGKDLPAVGEPPADEDSLALLIYTSGSTGAPKGAMYPQSNVGKMWRRGSKNWFGE
SAASITLNFMPMSHVMGRSILYGTLGNGGTAYFAARSDLSTLLEDLELVRPTELNFVPRIWETLYGEFQR
QVERRLSESGDAGERRAVEAEVLAEQRQYLLGGRFTFAMTGSAPISPELRNWVESLLEMHLMDGYGSTEA
GMVLFDGEIQRPPVIDYKLVDVPDLGYFSTDRPHPRGELLLRTENMFPGYYKRAETTAGVFDEDGYYRTG
DVFAEIAPDRLVYVDRRNNVLKLAQGEFVTLAKLEAVFGNSPLIRQIYVYGNSAQPYLLAVVVPTEEALA
SGDPETLKPKIADSLQQVAKEAGLQSYEVPRDFIIETTPFSLENGLLTGIRKLAWPKLKQHYGERLEQMY
ADLAAGQANELAELRRNGAQAPVLQTVSRAAGAMLGSAASDLSPDAHFTDLGGDSLSALTFGNLLREIFD
VDVPVGVIVSPANDLAAIASYIEAERQGSKRPTFASVHGRDATVVRAADLTLDKFLDAETLAAAPNLPKP
ATEVRTVLLTGATGFLGRYLALEWLERMDMVDGKVIALVRARSDEEARARLDKTFDSGDPKLLAHYQQLA
ADHLEVIAGDKGEANLGLGQDVWQRLADTVDVIVDPAALVNHVLPYSELFGPNALGTAELIRLALTSKQK
PYTYVSTIGVGDQIEPGKFVENADIRQMSATRAINDSYANGYGNSKWAGEVLLREAHDLCGLPVAVFRCD
MILADTTYAGQLNLPDMFTRLMLSLVATGIAPGSFYELDADGNRQRAHYDGLPVEFIAAAISTLGSQITD
SDTGFQTYHVMNPYDDGIGLDEYVDWLVDAGYSIERIADYSEWLRRFETSLRALPDRQRQYSLLPLLHNY
RTPEKPINGSIAPTDVFRAAVQEAKIGPDKDIPHVSPPVIVKYITDLQLLGLL
```

Nucleotide sequence (SEQ ID NO:51)

>uniprot|A3PYW9|A3PYW9_MYCSJ Thioester reductase domain

ATGTCCACCGAGACCCGTGAAGCGCGCCTGCAGCAGCGCATCGCGCATCTGTTCGCCACC
GACCCGCAGTTCGCCGCCGCCCGGCCCGACCCCCGGATCAGCGATGCCGTCGACCGCGAT
GACGCGCGGCTGACCGCCATCGTCTCCGCCGTCATGTCGGGGTACGCCGACCGGCCGGCA
CTCGGGCAGCGCGCCGCCGAATTCGCCACCGACCCGCAGACCGGCCGCACCACGATGGAG
CTGCTCCCCGCTTCGACACCATCACCTACCGGGAGCTGCTCGACCGCGTCCGGGCGCTC
ACCAACGCGTGGCACGCCGACGGGGTGCGCCCGGCGACCGCGTCGCAATCCTCGGATTC
ACCGGCATCGACTACACCGTCGTCGACCTCGCCCTGATCCAGCTCGGCGCGGTCGCGGTG
CCGCTGCAGACCAGCGCCGCCGTGGAGGCGCTGCGCCCGATCGTGGCCGAGACCGAACCG
ATGCTCATCGCCACCGGCGTCGATCATGTCGACGCCGCCGCGGAACTCGCACTCACCGGC
CACCGTCCGTCCCAGGTGGTGGTCTTCGACCACCGCGAGCAGGTCGACGACGAACGCGAC
GCGGTGCGGGCCGCGACGGCCCGGCTGGGAGACGCGGTGCCCGTCGAGACACTCGCCGAG
GTGTTGCGGCGTGGCGCCCATCTGCCCGCCGTGGCACCGCACGTGTTCGACGAGGCCGAT
CCACTGCGGCTGCTGATCTACACCTCCGGCAGCACCGGCGCCCCCAAGGGCGCGATGTAT
CCCGAGAGCAAGGTCGCCGGCATGTGGCGCGCGTCGGCCAAGGCCGCCTGGAACAACGAT
CAGACGGCGATTCCGTCGATCACCCTGAACTTCCTGCCGATGAGCCACGTCATGGGTCGC
GGCCTGCTGTGCGGCACGCTCAGCACCGGTGGCACCGCGTATTTCGCCGCCCGCAGCGAT
CTGTCGACGCTGCTCGAGGACCTGCGCCTGGTACGGCCCACCCAACTCAGCTTCGTGCCA
CGGATCTGGGACATGCTCTTCCAGGAGTTCGTCGGCGAGGTCGACCGGCGGGTGAACGAC
GGTGCAGACCGCCCCACCGCGGAGGCCGACGTGCTGGCCGAACTGCGCCAGGAGCTGCTC
GGTGGCCGGTTCGTCACCGCGATGACCGGTTCGGCGCCCATCTCCCCCGAGATGAAGACA
TGGGTGGAGACCCTGCTCGACATGCACCTGGTCGAGGGTTACGGCTCGACGGAGGCCGGC
GCGGTGTTCGTCGACGGCCACATCCAGCGCCCGCCGGTGCTCGACTACAAACTCGTCGAC
GTCCCCGACCTCGGCTACTTCAGCACCGACCGGCCGCACCCGCGCGGTGAGCTGCTGGTC
CGCTCCACGCAGCTGTTCCCCGGCTACTACAAGCGTCCCGACGTCACCGCCGAGGTGTTC
GACGACGACGGCTTCTACCGCACGGGCGACATCGTCGCCGAGCTCGGCCCCGACCAGCTG
CAGTACCTCGACCGCCGCAACAACGTGCTCAAACTCGCCCAGGGTGAGTTCGTCACCATC
TCCAAACTCGAGGCGGTCTTCGCCGGCAGCGCCCTCGTCCGCCAGATCTTCGTGTACGGC
AACAGTGCGCGCTCCTACCTGCTGGCCGTCGTCGTGCCGACCGACGATGCGGTGGCCCGG
CACGACCCGGCATCGCTCAAGACCGCGATCAGCGCCTCGCTGCAGCAGGCCGCGAAGACC
GCCGGTCTGCAGTCCTACGAGCTGCCGCGTGACTTCCTCGTCGAGACTCAACCGTTCACG
CTGGAGAACGGACTACTGACCGGCATCCGCAAGCTGGCCCGCCCGAAACTCAAGGCGCGC
TACGGCGATCGGCTCGAGGCGCTCTACGTCGAACTGGCCGAAGGACAGGCAGGCGAACTG
CGCACCCTGCGCCGGGACGGCGCGAAGCGTCCGGTGGCCGAGACGGTCGGCCGCGCCGCG
GCCGCGCTGCTCGGCGCCGCCGCCGCCGACGTGCGCCCCGACGCGCACTTCACCGACCTC
GGCGGAGACTCGTTGTCGGCGTTGACCTTCGGCAATCTGCTGCAGGAGATCTTCGGCGTC
GACGTCCCGGTCGGGGTGATCGTCAGCCCGGCGGCCGACCTGGCGTCGATCGCGGCGTAC
ATCGAGACCGAACAGGCCTCGACCGGCAAGCGGCCGACCTACGCGTCGGTGCACGGGCGC
GACGCCGAACAGGTACGCGCGCGCGACCTCACCCTGGACAAGTTCATCGACGCCGAAACA
CTCTCCGCTGCAACAGAACTGCCCGTCCCGATCGGTGAGGTGCGCACCGTGCTGCTGACC
GGGGCCACCGGATTCCTCGGCCGCTACCTGGCGCTGGACTGGCTCGAAAGGATGGCCCTG
GTCGACGGCAAGGTCATCTGCCTGGTCCGCGCGAAGGACGATGCGGCCGCCCGCAAACGC
CTCGACGACACCTTCGACAGCGGCGATCCGAAGCTGCTGGCGCACTACCGCAAGCTGGCC
GCCGACCACCTCGAAGTGCTGGCCGGCGACAAGGGTGAGGCGGATCTCGGGCTGCCGCAT
CAGGTCTGGCAGCGACTGGCCGACACCGTCGACCTCATCGTCGACCCGGCCGCCCTGGTC
AACCACGTACTGCCGTACAGCCAGCTGTTCGGGCCCAACGCGCTGGGCACTGCCGAGCTG
ATCCGGCTTGCGCTCACCACCCGCATCAAACCGTTCACCTACGTGTCGACGATCGGCGTC
GGCGCCGGTATCGAACCGGGCCGTTTCACCGAGGACGACGACATCCGGGTGATCAGCCCG

FIG. 8EE

```
ACGCGGGCCGTCGACACCGGGTACGCCAACGGCTACGGCAACAGCAAGTGGGCCGGTGAG
GTGTTGTTGCGCGAGGCGCACGATCTGTGCGGGCTCCCCGTGGCGGTGTTCCGGTGCGAC
ATGATCCTGGCCGACACCACCTACGCCGGCCAGCTCAACCTGCCGGACATGTTCACCCGG
ATGATGGTGAGCCTGGTGACCACGGGTATCGCGCCGAAGTCGTTCCACCCACTCGACGCA
AAGGGCCACCGGCAGCGCGCCCACTACGACGGGCTGCCGGTCGAGTTCGTCGCCGAATCG
ATCTCCGCGCTGGGAGCGCAGGCGGTCGACGAGGCGGGAACGGGTTTCGCCACCTACCAC
GTGATGAACCCCCACGACGACGGGATCGGCCTCGACGAATTCGTCGACTGGCTCGTCGAG
GCGGGGTATCGCATCGACCGCATCGACGACTACGCGGCCTGGCTGCAACGGTTCGAAACC
GCGCTGCGGGCGCTGCCCGAGCGCACTCGGCAGTACTCACTGCTCCCGCTGCTGCACAAC
TACCAGCGGCCTGCGCACCCGATCAACGGGGCGATGGCCCCGACCGACCGGTTCCGCGCC
GCGGTGCAGGAGGCAAAGCTCGGCCCGGACAAGGACATTCCCCACGTCACCCCCGGGGTG
ATCGTCAAGTACGCCACCGACCTGGAACTGCTGGGGCTGATCTAG
```

Amino acid sequence (SEQ ID NO:52)

>uniprot|A3PYW9|A3PYW9_MYCSJ Thioester reductase domain

```
MSTETREARLQQRIAHLFATDPQFAAARPDPRISDAVDRDDARLTAIVSA
VMSGYADRPALGQRAAEFATDPQTGRTTMELLPRFDTITYRELLDRVRAL
TNAWHADGVRPGDRVAILGFTGIDYTVVDLALIQLGAVAVPLQTSAAVEA
LRPIVAETEPMLIATGVDHVDAAAELALTGHRPSQVVVFDHREQVDDERD
AVRAATARLGDAVPVETLAEVLRRGAHLPAVAPHVFDEADPLRLLIYTSG
STGAPKGAMYPESKVAGMWRASAKAAWNNDQTAIPSITLNFLPMSHVMGR
GLLCGTLSTGGTAYFAARSDLSTLLEDLRLVRPTQLSFVPRIWDMLFQEF
VGEVDRRVNDGADRPTAEADVLAELRQELLGGRFVTAMTGSAPISPEMKT
WVETLLDMHLVEGYGSTEAGAVFVDGHIQRPPVLDYKLVDVPDLGYFSTD
RPHPRGELLVRSTQLFPGYYKRPDVTAEVFDDDGFYRTGDIVAELGPDQL
QYLDRRNNVLKLAQGEFVTISKLEAVFAGSALVRQIFVYGNSARSYLLAV
VVPTDDAVARHDPASLKTAISASLQQAAKTAGLQSYELPRDFLVETQPFT
LENGLLTGIRKLARPKLKARYGDRLEALYVELAEGQAGELRTLRRDGAKR
PVAETVGRAAAALLGAAAADVRPDAHFTDLGGDSLSALTFGNLLQEIFGV
DVPVGVIVSPAADLASIAAYIETEQASTGKRPTYASVHGRDAEQVRARDL
TLDKFIDAETLSAATELPVPIGEVRTVLLTGATGFLGRYLALDWLERMAL
VDGKVICLVRAKDDAAARKRLDDTFDSGDPKLLAHYRKLAADHLEVLAGD
KGEADLGLPHQVWQRLADTVDLIVDPAALVNHVLPYSQLFGPNALGTAEL
IRLALTTRIKPFTYVSTIGVGAGIEPGRFTEDDDIRVISPTRAVDTGYAN
GYGNSKWAGEVLLREAHDLCGLPVAVFRCDMILADTTYAGQLNLPDMFTR
MMVSLVTTGIAPKSFHPLDAKGHRQRAHYDGLPVEFVAESISALGAQAVD
EAGTGFATYHVMNPHDDGIGLDEFVDWLVEAGYRIDRIDDYAAWLQRFET
ALRALPERTRQYSLLPLLHNYQRPAHPINGAMAPTDRFRAAVQEAKLGPD
KDIPHVTPGVIVKYATDLELLGLI
```

CAR70557

Nucleotide sequence (SEQ ID NO:53)

>gi|219932450:561817-562104 Mycobacterium leprae Br4923, complete genome sequence

```
ATGAGCACCGTGGATGGTGTGTGTGATGAAGACATATATTACTATTATGACTGCATATATTGCGCTGCCG
ATGTTGCCAGCCCGACTGGGTATTTACCCGGAGGACTCTTTAGCTTGGCGAAGCTGCTTGTTATACGTGG
GGAGAAGCAGTATGTCTTCGGCCTGAATGACTCGACGAGTGTCGGCCCCGGGCCGGGCAACATGCCCTGG
CTGGACGACCCAGGCCTGTCTGCTGTCATTGCGAGTTCCGTCGCAGCGGCTGAATTGGCTGCTGCGCGAT
CCTGGTAA
```

FIG. 8FF

Amino acid sequence (SEQ ID NO:54)

>gi|219932734|emb|CAR70557.1| hypothetical protein [Mycobacterium leprae Br4923]
MSTVDGVCDEDIYYYDCIYCAADVASPTGYLPGGLFSLAKLLVIRGEKQYVFGLNDSTSVGPGPGNMPW
LDDPGLSAVIASSVAAAELAAARSW

YP 001220863.1

Nucleotide sequence (SEQ ID NO:55)

>uniprot|A5CM59|A5CM59_CLAM3 Putative acyl-CoA synthetase

```
ATGAGCACTGAGCAGATGGGCACCGAGCAGATGGGGAGCCAGCACGAGGACACGTCGATC
GAGGCGATCTTCGCGCAGCACGCCGACCGGACGGCGCTGCGGCAGCGATCCGGGCCGGAC
ATCACGGACATGGGCTTCCGGGAGCTGTGGGACCGGGCGGGCGCGCTGGCCGCGGCGCTC
GGCGAGACCGTGTCCGCCGGAGACCGCATCGCGGTGCTCGGCACGGCGACCGCGGACGCC
GTCACGCTCGACCTCGCCGCGTGGATCCTCGGCGCGGTGAGCGTGCCCCTCCAGGCGAGC
GCGCCCGTCGCGGCCCTGCGCGCGATCGTCGAGGAGACGACGCCGGTGTGGATCGCGGCC
ACCGCCGACCAGGCCGCGACGGCCCGGGCGGTCGCCGAGGCATCGGGCGACGGCATCCGG
ACGATGCGGCTCGACACCGACACCGACGCGGACACCGACACCGACGCCGCCCTGACGCTC
GGCGCGCTCGTCGCCCGCGGGGCCGGCCTGCGTCGCCGGAGCCCGTGGCACCCCGCACCC
GGCGACGACCCGCTCGCGCTCCTGCTCTACACGTCGGGCAGCACGGGCACGCCGAAGGGC
GCGATGTACACGCGCTCCATGGTCGAGCGGATGTGGCACGCCCTCCGGCCCGACCCCGCC
GCGCCCGCCGACGCATCCACGACCGCGGACGACGGAGACGCCGCAGCCATCGTCGGGTAC
GCGTACCTCCCCATGAGCCACCTCACCGGCCGCTCCTCCCTGCTCGCCACGCTCGGCCGC
GGCGGCACGGTCGCGCTCGCGACCTCGACCGACCTGTCGACGCTCTTCGACGACCTGCGG
ACCTTCGCCCCGACCGAGTTCGTCTTCGTGCCGCGCGTCGCGGAGCTGGTGCGGCAGGAG
GGCGACCGCGAGGAGCAGCGCCGACTCACCGCCGGCAGCACGGACCGGGACGCGGTCCGC
GCCGAGGTCCAGGCCGACCTGCGCGCCCGCGCGTTCGGCGGACGGATCCACCGGGCGATC
TGCACCAGCGCACCGCTGACGCCGGAGCTCCGCACGTACATCGAGGGATGCCTCGGGCTG
ACGCTGCACGACCTGTACGGGTCGACCGAGGCCGGCGGCATCCTCCACGACGGGTGATC
CAGCAGCCTCCCGTCACCGAGCACAAGCTCGTCGACGTCCCCGAGCTCGGGTACCGCACC
ACCGACCGCCCGCACCCGCGGGGCGAGCTGCTCGTCAAGAGCGCCTCCGTGATCGCCGGG
TACTTCCGCCGGCCGGACGTCACCGCCGCGGTGTTCGACGAGGACGGCTTCTACCGGACC
GGCGACGTCATGGCGCAGACCGGACCCGGCACCTACGAGTACGTCGACCGTCGGAACAAC
GTGATCAAGCTGTCGCAGGGCGAGTTCGTCGCGGTGGCATCGCTCGAGGCGACGTACGGC
GGGACGCCCGAGGTGCACCAGATCGCGCTGCACGGCGACAGCCGGCACGCGTTCCTCGTC
GCGGTCGTCGTCCCGGCGGACCCCGCGGCGTCGGAGCGCGACATCCTCGCGGCCCTCCAG
CGCACCGCCCGCGAGCACGGCCTCGCCCCTACGAGGTGCCCCGCGGCGTGATCGTCGAA
CCGGATCCGTTCACGGTCGACGGCGGCATGCTCTCCGACGCCGGCAAGCTCCTGCGCCTG
CGCCTCACGCAGCGGTACGGCGAGCGCCTCGCCGCCCTCTACGACGCGCTCGAGGAGCAG
CAGAGCGGCACCCTCGTCGCCGCGCTCCGCGAACGCGCCGACGACGAGCCGACGGTCGAC
ACGGTGGTGCGCGCCGCCCTCCTGCTCCTCGGGGCCGAGGTGTCCCCGCGACCGCCGCC
GCTGCCCGGTTCTCCGACCTCGGCGGCGACTCGCTGTCCGCGCTGACGTTCTCCGGGATC
CTCGAGGACGTCTTCGGCACCGAGGTGCCCGTCGGCGTCCTCACCGACCCGACCAACGAC
CTCGCCGCCGTCGCCGCCTACGTGGAGCGCTCCGCCTCCGACGACCGGCCGACCGTGACC
CGCGTGCACGGCGCCGGCGCATCCACCCTCCGCGTGGGCGACCTCCGGCTCGACCGGATG
CTCGGCGGCATCCCGACGCCGGTCCCCGGGCCTCGGCCGCCCGGCCGGGATCCCGCACG
```

FIG. 8GG

```
GTCCTGCTCACCGGCGCGAACGGCTACCTCGGCCGGTTCCTGGCCATCGACTGGCTCGAG
CGCCTCGCTGCGACGGGCGGCACGCTGGTGTGCATCGTGCGCGGCGCCGACGACGCCGAC
GCCCGGCGCCGCCTCGAGGCCGCGTTCGCCGCGGATCCCGCGTTCGCCCGGCGCTTCGCC
GAGCTGTCGGGCTCGCTCGAGGTGCTGGCCGGAGACGTCAGCGAGCACCGCCTCGGCCTC
GACGACGAGCGGTGGATCGACCTGGCCGCGCGGGTCGACCTCGTCGCGCACGCGGCTGCC
CTCGTGAACCACGTCCTCCCCGTACTCGGCGCTGTTCGGTCCGAACGTCGTCGGCACCGCC
GAGGCGATCCGCCTGGCGATCGCCGCCGGCAGCGTGCCCGTCACCTTCGTCTCGAGCGTC
GCGGTCGCGGGCGGCGCGCGGCCGGGCGCGACCGCCGACGCCGAGCCGTCGGCGCCCGGC
GCGCTCGACGAGCACGCCGACATCCGCGCCACGATCCCCGAGTGGGCCGTCGGCGACGAG
TACGCCAACGGGTACGGCGCGAGCAAGTGGGCGAGCGAGGTGCTGCTCCGCGAGGCGCAC
GAGCACCACGGCGTCCCCGTGGCCGTGTTCCGCTCCGACATGATCCTGGCGCACCCCCGC
TGGCGCGGTCAGGTGAACCTCCCCGACGTCTTCACCCGGCTGATCTGGAGCGTGCTCACC
ACCGGCCTCGCCCCCGCATCGTTCGTGAGGCGCGGCCCCGACGGCGAGCGGCAGCGGTCG
CACTACGACGGGCTGCCGGCCGACTTCACGGCGGCGGCGATCGACGGGATCGGCGCGGCG
CTCACCGAGGGCACCGCACCTTCAACGTCGTGAACCCCCACGACGACGGCGTCTCGCTC
GACACCTTCGTCGACTGGATCCGCGAGGACGGCCACGACATCGCGCGCGTGGACGACCAC
GCGGAGTGGGTCGACCGGTTCCGCGCGGCGCTGGGAGCGCTCCCGGACGCGGACCGCGCC
CGGTCCGTCCTGCCGCTGATGCACGCGTTCGCCTCGCCCGAGGAGCCGCACGCCGGCTCG
GCGATCCCGGCGGATGCGTTCGCCGAGGCCGTCCGCGCGGTGCGCCCGCTCGGGTCGCCG
GACATCCCGTCTCTCGACCACGCGCTCATCGCCAAGGTCGCCGACGACCTCGCGTTCCTG
GGGCTGCTCGCGCCGGCGCGGGCGGCGGCTGCCTGA
```

Amino acid sequence (SEQ ID NO:56)
>uniprot|A5CM59|A5CM59_CLAM3 Putative acyl-CoA synthetase

```
MSTEQMGTEQMGSQHEDTSIEAIFAQHADRTALRQRSGPDITDMGFRELW
DRAGALAAALGETVSAGDRIAVLGTATADAVTLDLAAWILGAVSVPLQAS
APVAALRAIVEETTPVWIAATADQAATARAVAEASGDGIRTMRLDTDTDA
DTDTDAALTLGALVARGAGLRRRSPWHPAPGDDPLALLLYTSGSTGTPKG
AMYTRSMVERMWHALRPDPAAPADASTTADDGDAAAIVGYAYLPMSHLTG
RSSLLATLGRGGTVALATSTDLSTLFDDLRTFAPTEFVFVPRVAELVRQE
GDREEQRRLTAGSTDRDAVRAEVQADLRARAFGGRIHRAICTSAPLTPEL
RTYIEGCLGLTLHDLYGSTEAGGILHDGVIQQPPVTEHKLVDVPELGYRT
TDRPHPRGELLVKSASVIAGYFRRPDVTAAVFDEDGFYRTGDVMAQTGPG
TYEYVDRRNNVIKLSQGEFVAVASLEATYGGTPEVHQIALHGDSRHAFLV
AVVVPADPAASERDILAALQRTAREHGLAPYEVPRGVIVEPDPFTVDGGM
LSDAGKLLRLRLTQRYGERLAALYDALEEQQSGTLVAALRERADDEPTVD
TVVRAALLLLGAEVSPATAAAARFSDLGGDSLSALTFSGILEDVFGTEVP
VGVLTDPTNDLAAVAAYVERSASDDRPTVTRVHGAGASTLRVGDLRLDRM
LGGIPTPVPRASAARPGSRTVLLTGANGYLGRFLAIDWLERLAATGGTLV
CIVRGADDADARRRLEAAFAADPAFARRFAELSGSLEVLAGDVSEHRLGL
DDERWIDLAARVDLVAHAAALVNHVLPYSALFGPNVVGTAEAIRLAIAAG
SVPVTFVSSVAVAGGARPGATADAEPSAPGALDEHADIRATIPEWAVGDE
YANGYGASKWASEVLLREAHEHHGVPVAVFRSDMILAHPRWRGQVNLPDV
FTRLIWSVLTTGLAPASFVRRGPDGERQRSHYDGLPADFTAAAIDGIGAA
LTEGHRTFNVVNPHDDGVSLDTFVDWIREDGHDIARVDDHAEWVDRFRAA
LGALPDADRARSVLPLMHAFASPEEPHAGSAIPADAFAEAVRAVRPLGSP
DIPSLDHALIAKVADDLAFLGLLAPARAAAA
```

Nucleotide sequence (SEQ ID NO:57)

>uniprot|A8M8D3|A8M8D3_SALAI Thioester reductase domain

```
GTGACCACCACGGAGCAGACCCTCACCGAGCGGCTCATCGCCGAGGACGAGCAGATCCGG
CGGGCCCAGGTCAGCGCCGAAGTCTCCGCCGCGATGCGGGTGCCGGGCATGTCGCAGGCC
CAGATCGTGGCCGCCGGATTCACCGGTTACGCCGACCGCGCCGCCCTGGGTGAGCGCGCC
CGCGAAGCCGTCACCGACCCGGTCACCGGCCGCACCACCCACCGGCTTCTGCCATGGTTC
GACACCATCACCTACGGCGAGGTCCGGTCGCGGGTGCTGGCGATCTCCGCCGCCTGGTGG
CACGACGTGGACGCTCCACTCCGTCCCGGCGCCTTCGTCGTTTCGGTCGGCGTCCCCAGC
GCCGACCTCGTGACGGTCGAGCTCGCGGTGCTACACACCGGCGCGGTCAGTGTGCCACTG
CAGGTCAGCTCCACCGCCGAGCAACTGCGCCCGATCCTCGACGAGGCCGCCCCGCTCATC
GTGGCCACGAGCGTGGACCGGCTCGCTGTGGTGACCGCGGCGATGTCGGGCAACGCGTCG
GTGCGCCGGATCATGGTCCTGAACCACGACGCAGCGATCACCGCCCACCGGGATGCCGTG
GACGCCGCGCGATCGGCGCTCGCCGGCACCGCAGTCGTCGTGCACACATTGACCGAGGTG
TTGGACCGTGGACGGGGCCTGCCCGCCCCTGAGCCCTACGCGGCGCCCACGGGGGAGGAT
CCCCTGTCGCTGTTGATCTACACCTCGGGCAGTACCGGTACGCCCAAGGGCGCAATGTTT
CCGGAGAGCATGACCCGCGCCAACTGGGTGCGTTTCGACCCCAAGCCGACCGACATGGCG
GTCATCCGGCTCAACTACCTGCCGCTGAGCCACAACGTCGGCCGCATCGTGCTGTTCGAG
GCGCTCGCGGTGGGCGGCATCGCCTTCTTCACCGCACACAGTGACCTGTCCACGCTCCTG
GAGGACATGGCCCTCGCCCGGCCCACCGACCTGTTCCTTATCCCGCGGCTGTGCGACATG
CTCGCCCAGCGCCACGACAGCGAACTGGCCCGCCGCCGCATCACCACCGCGGATCACGAG
GGGGTCCGACAGGTCCACACCCATCTGCGCGAGGCTGTCCTCGGCGGCAGGGTGACCCGC
GCGATGTCGCTGTCCGCGCCGCTGAGCCCACAGCTGCGTCGGTTCGTGGAGTCGTGTCTC
GGCTTCGCGGTGCACGATGTCTTCGGGTCGACCGAGGCCGGCGGGCTGCTCGTCAACGGC
CGGGTGCTGCGCCCGCCGGTGCTCGACTATCGCTTGGTCGACGTCCCCGACCTCGGCTAC
TTCACCACCGACCGTCCGTACCCTCGCGGGGAGCTGCTGGTGCGGACCGCGACGATCATC
CCCGGCTACTACCAGCGGCCCGAGCTCAACGCCGAGCTGTTCACCGAGGACGGCTACTAC
CGCACCGGCGACATCATGGCCGAGTACGGCCCCGACCACCTCGGCTATGTCGACCGCACC
ACGAGCGTGCTGAAGCTGTCACAGGGCGAGTTCGTGGCCGTGTCACGGTTGGAGGAACTG
TTCGCCGCCTCCCCGCTGATCCGGCAGATCTACCTGTACGGCAACAGCGAGCGGCCGTAC
CTGCTCGCCGTGGTCGTGCCCACGGAGGAGGCGCACGCCGCCACCCGGGAACCGCGGCG
CTCAAGGCGGTGCTCGGCGAGTCGCTGCAACGCATCGCTCAGCAGCACGGCCTGCACCCG
TACGAGGTGCCGCGCGACCTCCTCATCGAGACCACCCCGTTCAGCACCGCCAACGGTCTG
CTCTCCGACATCCGTAAGCCCCTGCGTCCGAAGCTCAAGACCCGGTACGCTCCTCGACTC
GAAGCGCTCTACACCGAGCTCGCCGAGCGCGAGGCCGACCGGATCCGCACGCTGCGCGAC
GCCGGTTCCGCGCAACCCGTGCTGCCCGCGTTGCGCGAGGCTGCCCGGGCGTTCCTCGGC
CGCCCAGGCGCAGCGCTCGACGTGAACGACCGCTTTGTGGACCTCGGCGGCGACTCCCTG
TCGGCCCTGGCCCTGTCGAACCTGCTGAGCGACATCTTCGAGGTCCGCGTCCCGGTCGGC
ATCATGATCAGCGCGACCGGCACGCTCGGTTCCGTGGCGGCCTGGATCGAGGCCGAGCGT
GCCACCGCCGGAGCGGGTATCGGCCGCGCGACGCCCACCTCCGTGCACGGTGCGAACCTC
ACCCAGGTACACGCCGATGACCTGACCCTCGGCACGTTCCTCGACGTGACGACCCTCGCC
GCCGCTGCCTGCCTGCCCCGGGCGCCGCTGTCCGACCCGCGCGTGGTGCTGCTGACGGGT
GCGACCGGCTATCTGGGCCGGTTCCTGGCCCTCGAGTGGCTGGACCGCCTTTCCCGTAGC
GGCGGGACGCTCGTGTGCGTGGTGCGCGCCGCCGACGATGCGGAAGCCGCGCGCCGCCTG
GAAAGTGTCTATGGCTCCAGCGACCCCGAGTTGCTGGAGCGCTTCCGTTCACTCGCCGGC
CACGTGCGCGTGTTGGCCGGCGATGTTGCCGAAGCCAGGTTCGGCCTGCCGGCCGGGGTG
TGGCAGGAACTGGCCGAAACGGTGGACCTGATCGTGCACTCCGCGGCACTGGTCAACCAC
GTTCTCCCGTACGAACAGCTGTTCGGGCCCAACGTGGCGGGAACGGCGGAACTGGTGCGC
CTCGCCGTCAGCGTACGGGTGAAGGGAATTGCCTTTCTCTCCACCGTTGCCGTGATCACC
TCGCAGACCACGACACCCGACGAGGACGCGGACATCCGGCAGGCGAGCCCGCACCGGGTG
```

FIG. 8II

```
CTCGACGACAGCTACGCGAACGGCTACGCGGCCAGCAAGTGGGCAGGTGAGGTGCTCCTG
CGACGCGCCCACGAGGAGTACGGCGTGCCGGTCAGCGTGTTCCGCTCGGACGTCATCCTG
GCCCACTCCCGCTACGCCGGGCAGCTCAACGTCCCGGATATGTTCACGCGCCTGCTCCTG
AGCATCCTGGCGACCGGTATTGCCCCAGCGTCGTTTTATCGCACCGGCCCGGACGGCGAA
CGCCAGCCGGCGCACTACGACGGTCTCCCGGTCGACTTCACCGCGGCGGCCGTAGCCGCG
GTGGGTGTCACCGAGGGACACCGCACCTTCAACGTACTGAATCCACACGAGGACGGCATC
GGGCTGGATACCTTTGTGGACTGGCTCGTGGCAGCCGGACACCCGGTGCAGCGCATCGCG
GACCACGACGAGTGGGTGACCCGCTTCGCCACGGCCATGCGTGGGCTGCCTGAACGCCAG
CGCCGCAGCTCGATCCTGCCGCTCCTACACGCCTTTGCCGAGCCCGCTCCGCCGACCTTC
GGATCCAGACTGCCGACGGACCGGTTTCGCGCCGCCGTGAAAGCCGCCAACGTGGTCCCC
GGCAACGAGATCCCGCACCTCGATGCGGCCCTCGTCACCAAGTACGCCGACGACCTCAGG
CTGCTCGACCTTCTCTGA
```

Amino acid sequence (SEQ ID NO:58)

>uniprot|A8M8D3|A8M8D3_SALAI Thioester reductase domain

```
VTTTEQTLTERLIAEDEQIRRAQVSAEVSAAMRVPGMSQAQIVAAGFTGY
ADRAALGERAREAVTDPVTGRTTHRLLPWFDTITYGEVRSRVLAISAAWW
HDVDAPLRPGAFVVSVGVPSADLVTVELAVHTGAVSVPLQVSSTAEQLR
PILDEAAPLIVATSVDRLAVVTAAMSGNASVRRIMVLNHDAAITAHRDAV
DAARSALAGTAVVVHTLTEVLDRGRGLPAPEPYAAPTGEDPLSLLIYTSG
STGTPKGAMFPESMTRANWVRFDPKPTDMAVIRLNYLPLSHNVGRIVLFE
ALAVGGIAFFTAHSDLSTLLEDMALARPTDLFLIPRLCDMLAQRHDSELA
RRRITTADHEGVRQVHTHLREAVLGGRVTRAMSLSAPLSPQLRRFVESCL
GFAVHDVFGSTEAGGLLVNGRVLRPPVLDYRLVDVPDLGYFTTDRPYPRG
ELLVRTATIIPGYYQRPELNAELFTEDGYYRTGDIMAEYGPDHLGYVDRT
TSVLKLSQGEFVAVSRLEELFAASPLIRQIYLYGNSERPYLLAVVVPTEE
AHAATREPAALKAVLGESLQRIAQQHGLHPYEVPRDLLIETTPFSTANGL
LSDIRKPLRPKLKTRYAPRLEALYTELAEREADRIRTLRDAGSAQPVLPA
LREAARAFLGRPGAALDVNDRFVDLGGDSLSALALSNLLSDIFEVRVPVG
IMISATGTLGSVAAWIEAERATAGAGIGRATPTSVHGANLTQVHADDLTL
GTFLDVTTLAAAACLPRAPLSDPRVVLLTGATGYLGRFLALEWLDRLSRS
GGTLVCVVRAADDAEAARRLESVYGSSDPELLERFRSLAGHVRVLAGDVA
EARFGLPAGVWQELAETVDLIVHSAALVNHVLPYEQLFGPNVAGTAELVR
LAVSVRVKGIAFLSTVAVITSQTTTPDEDADIRQASPHRVLDDSYANGYA
ASKWAGEVLLRRAHEEYGVPVSVFRSDVILAHSRYAGQLNVPDMFTRLLL
SILATGIAPASFYRTGPDGERQPAHYDGLPVDFTAAAVAAVGVTEGHRTF
NVLNPHEDGIGLDTFVDWLVAAGHPVQRIADHDEWVTRFATAMRGLPERQ
RRSSILPLLHAFAEPAPPTFGSRLPTDRFRAAVKAANVVPGNEIPHLDAA
LVTKYADDLRLLDLL
```

YP 001703694.1

Nucleotide sequence (SEQ ID NO:59)

>uniprot|B1MCR9|B1MCR9_MYCAB Probable fatty-acid-CoA ligase FadD

```
ATGACCGTGACCAACGAAACCAACCCACAGCAGGAGCAGCTATCCCGCCGTATTGAAAGT
CTGCGCGAAAGCGATCCGCAGTTCCGGGCGGCCCAGCCCGACCCGGCGGTCGCCGAACAG
GTGCTGCGCCCGGGCCTGCATCTTTCTGAAGCCATTGCGGCGTTGATGACTGGATACGCT
GAGCGCCCGGCGCTCGGTGAGCGCGCACGCGAGTTGGTCACCGACCAGGATGGCCGCACC
```

FIG. 8JJ

```
ACGCTGCGCCTGTTGCCACGCTTCGACACCACCACATACGGCGAATTATGGTCCCGCACA
ACATCAGTCGCCGCTGCATGGCACCACGACGCCGCCCACCCGGTTAAGGCCGGCGATCTG
GTGGCCACCCTGGGATTCACCAGCATCGACTACACCGTGCTGGATCTGGCGATCATGATC
CTCGGTGGCGTGGCGGTTCCGCTACAGACCAGCGCCCGGCTTCGCAGTGGACGACCATT
CTGGCCGAAGCGGAACCCAACACTCTTGCGGTAAGCATCGAATTGATCGGCGCTGCAATG
GAATCTGTGCGGGCCACGCCTTCCATCAAGCAGGTCGTCGTGTTCGACTACACCCCCGAG
GTCGATGATCAACGGGAGGCATTCGAGGCAGCAAGCACACAACTCGCCGGCACCGGCATC
GCCATTGAGACCCTCGATGCCGTCATCGCCCGCGGCGCCGCACTTCCGGCCGCACCGCTC
TACGCACCATCGGCCGGCGACGATCCGCTGGCGCTGCTCATCTACACCTCCGGCAGCACC
GGGGCTCCAAAGGGCGCCATGCACAGCGAAAACATCGTGCGCCGCTGGTGGATTCGTGAG
GACGTCATGGCCGGCACCGAGAACCTGCCCATGATCGGGCTGAACTTCATGCCGATGAGT
CACATCATGGGACGCGGCACCCTCACCTCCACCCTGTCTACCGGTGGAACCGGATACTTC
GCGGCGTCCAGTGACATGTCAACGCTCTTCGAGGACATGGAGCTGATCCGCCCGACGGCC
CTGGCCTTGGTTCCACGCGTGTGCGACATGGTGTTCCAGCGATTCCAGACCGAGGTGGAC
CGGCGTCTGGCGAGCAGCGACACCGCCAGTGCCGAGGCCGTTGCGGCCGAGGTCAAGGCC
GATATCCGTGACAACCTCTTCGGTGGCCGCGTATCGGCGGTCATGGTCGGTTCTGCTCCG
TTGTCCGAGGAGCTGGGTGAGTTCATCGAATCCTGCTTCGAGCTGAATCTGACCGATGGC
TACGGCTCCACCGAAGCCGGCATGGTGTTCCGCGACGGCATCGTGCAACGCCCGCCGGTC
ATTGACTACAAGCTGGTTGACGTGCCCGAACTGGGCTACTTCTCCACCGACAAGCCGCAC
CCGCGCGGTGAGCTGCTGCTGAAGACCGACGGCATGTTCCTCGGGTACTACAAACGCCCC
GAGGTGACTGCCGGCGTCTTCGACGCGGACGGTTTTTACATGACCGGCGACATCGTCGCC
GAGCTGGCCCACGACAACATCGAGATCATCGATCGCCGCAACAACGTGCTCAAACTCTCA
CAGGGAGAGTTTGTCGCGGTCGCCACCTTGGAGGCCGAGTACGCCAATAGCCCTGTGGTG
CACCAGATCTACGTCTACGGCAGCAGCGAACGGTCCTACCTGCTAGCAGTCGTGGTGCCG
ACGCCGGAGGCCGTGGCCGCCGCCAAGGGCGACGCGGCGGCACTCAAGACGACCATCGCG
GACTCGCTGCAGGACATTGCCAAGGAGATCCAGCTGCAGTCCTACGAAGTCCCCGTGAC
TTCATCATCGAACCGCAGCCATTCACCCAGGGCAACGGCCTGCTGACGGGTATCGCCAAG
CTGGCGCGTCCGAACCTGAAGGCGCACTATGGACCGCGGCTGGAGCAGATGTACGCCGAA
ATCGCCGAGCAGCAGGCTGCCGAGCTTCGGGCGTTGCACGGAGTGGACCCAGACAAGCCC
GCGCTGGAAACGGTCCTCAAGGCGGCGCAGGCCCTGCTCGGCGTCTCGTCGGCCGAACTG
GCCGCGGACGCGCATTTCACCGATCTAGGTGGCGATTCGCTGTCCGCACTGTCCTTCTCG
GATCTGCTGCGCGATATCTTCGCGGTCGAAGTACCGGTCGGAGTCATCGTCAGTGCCGCA
AACGATCTCAGCGGTGTTGCGAAATTTGTTGATGAACAACGCTATTCGGGCGGGACGCGG
CCGACCGCGGAGACGGTGCACGGCGCCGGGCATACGGAGATCCGGGCCGCGGACCTGACC
CTGGATAAGTTCATCGACGAGGCCACCCTGCATGCGGCACCGTCGCTTCCGAAGGCCGTC
GGGATCCCACACACCGTCCTGCTCACCGGGTCCAACGGCTACCTGGGCCACTACCTGGCA
CTGGAATGGCTTGAGCGCCTGGACAAGACAGAAGGCAAGCTGATCGCCATCGTCCGCGGT
AAGAATGCCGAGGCCGCCTACCGCCGCCTCGAGGAAGCCTTCGACACCGGCGACACGCAG
CTGTTGGCGCACTTCCGGTCGCTGGCCGACAAGCACCTCGAAGTACTGGCCGGCGATATC
GGCGACCCCAACCTTGGCCTGGATGCCGACACCTGGCAGCGCCTGGCCGACACCGTCGAC
GTCATCGTGCACCCCGCCGCCCTGGTCAACCACGTACTGCCCTACAGCCAGCTGTTCGGA
CCGAATGTCGTCGGCACCGCCGAGATCATCAAGCTGGCCATCACTACCAAGATCAAGCCG
GTCACCTACCTGTCCACGGTCGCGGTCGCGGCATATGTCGATCCGACGACATTCGACGAA
GAGTCCGATATCCGGCTCATCAGCGCGGTGCGTCCCGTGGACGAGCTGTACGCGAACGGC
TACGGCAACAGCAAGTGGGCCGGCGAGGTACTGCGCGAAGCCCACGATCTGTGCGGA
CTACCCGTCGCGGTCTTCCGCTCCGACATGATCTTGGCCCACAGCCGCTACACCGGACAG
CTCAACGTGCCCGACCAGTTCACCCGACTAATCCTCAGCCTCATCGCCACCGGAATCGCA
CCCGGCTCCTTCTACCAAGCACACGCCACCGGCGAACGCCCACTCGCCCACTACGACGGG
CTACCCGGTGACTTCACCGCCGAGGCGATCACCACGTTGGGCACCCAGGTGGTCGACAGC
TACGAGACCTACGACTGCGTGAACCGCATGCAGACGGAGTCTCGCTGGACAACTTCGTC
GACTGGCTCATCGAAGCCGGCTACCCCATCGCACGCATCGACAACTACACCGAATGGTTC
ACCCGCTTCGACACCGCCATCCGAAGCCTCCCCGAAAAACAGAAACAACACTCCCTACTA
CCACTGCTCCACGCATTCGAACAGCCGTCCGCCGCCGAGAACCACGGCGTCGTCCCGGCA
AAGCGTTTCCAGCACGCTGTGCAGGCCGCCGGAATCGGTCCGGCCGGGCAAGACGGCACT
```

ACCGACATTCCCCACCTGTCGCGGCGGCTGATCGTGAAATACGCCAAGGACCTCGAACAG
CTCGGACTCCTATGA

Amino acid sequence (SEQ ID NO:60)

>uniprot|B1MCR9|B1MCR9_MYCAB Probable fatty-acid-CoA ligase FadD

MTVTNETNPQQEQLSRRIESLRESDPQFRAAQPDPAVAEQVLRPGLHLSE
AIAALMTGYAERPALGERARELVTDQDGRTTLRLLPRFDTTTYGELWSRT
TSVAAAWHHDAAHPVKAGDLVATLGFTSIDYTVLDLAIMILGGVAVPLQT
SAPASQWTTILAEAEPNTLAVSIELIGAAMESVRATPSIKQVVVFDYTPE
VDDQREAFEAASTQLAGTGIAIETLDAVIARGAALPAAPLYAPSAGDDPL
ALLIYTSGSTGAPKGAMHSENIVRRWWIREDVMAGTENLPMIGLNFMPMS
HIMGRGTLTSTLSTGGTGYFAASSDMSTLFEDMELIRPTALALVPRVCDM
VFQRFQTEVDRRLASSDTASAEAVAAEVKADIRDNLFGGRVSAVMVGSAP
LSEELGEFIESCFELNLTDGYGSTEAGMVFRDGIVQRPPVIDYKLVDVPE
LGYFSTDKPHPRGELLLKTDGMFLGYYKRPEVTAGVFDADGFYMTGDIVA
ELAHDNIEIIDRRNNVLKLSQGEFVAVATLEAEYANSPVVHQIYVYGSSE
RSYLLAVVVPTPEAVAAAKGDAAALKTTIADSLQDIAKEIQLQSYEVPRD
FIIEPQPFTQGNGLLTGIAKLARPNLKAHYGPRLEQMYAEIAEQQAAELR
ALHGVDPDKPALETVLKAAQALLGVSSAELAADAHFTDLGGDSLSALSFS
DLLRDIFAVEVPVGVIVSAANDLSGVAKFVDEQRYSGGTRPTAETVHGAG
HTEIRAADLTLDKFIDEATLHAAPSLPKAVGIPHTVLLTGSNGYLGHYLA
LEWLERLDKTEGKLIAIVRGKNAEAAYRRLEEAFDTGDTQLLAHFRSLAD
KHLEVLAGDIGDPNLGLDADTWQRLADTVDVIVHPAALVNHVLPYSQLFG
PNVVGTAEIIKLAITTKIKPVTYLSTVAVAAYVDPTTFDEESDIRLISAV
RPVDELYANGYGNSKWAGEVLLREAHDLCGLPVAVFRSDMILAHSRYTGQ
LNVPDQFTRLILSLIATGIAPGSFYQAHATGERPLAHYDGLPGDFTAEAI
TTLGTQVVDSYETYDCVNPHADGVSLDNFVDWLIEAGYPIARIDNYTEWF
TRFDTAIRSLPEKQKQHSLLPLLHAFEQPSAAENHGVVPAKRFQHAVQAA
GIGPAGQDGTTDIPHLSRRLIVKYAKDLEQLGLL

YP 001703695.1

Nucleotide sequence (SEQ ID NO:61)

>uniprot|B1MCS0|B1MCS0_MYCAB Probable fatty-acid-CoA ligase FadD

ATGACGATCGACGCCACCGCGGACAACACCAAGGAAGCACGTCGTCAGCGGTTAGGCGAC
CGCATCAGGCGCCTATTCACCGACGATGAGCAGTTCCGTGCCGCCAAGCCCGATACCGCG
GTTGATACCGCCGTCGCCCAGCCTGGTCTGCGTCTCGCCCAGGTGGTCGCCACGATCATG
AACGGGTACGCGGACCGTCCGGCGCTCGGGCACCGAGTCCAGGAGCTCGTCGCCGACGCC
GCCGGCCGTTCGACGCTGCGCCCGTTGCCCGAGTTCGAGACGGTCACCTACGGAGAGCTG
TGGGGCATGGCCCGCGCGTTGGCCTCCACCTGGTACCACGATCCCGCCGCTCCGGTACGG
GCCGGGGACTTCGTCGCGATGCTCGGCTTCACCAGCGTGGACTACACCGCTGTCGACTTG
GCATGCATCCACCTTGGCGCGGTGGCGGTTCCATTGCAGACCAGCGCATCGGCATCCAAC
TGGACCGCGATCCTGGCCGAATCGGAACCTGCCGTCCTGGCGGTAAGCGCCGAGTTGCTC
GATACGGCAATGGAATCGGTGCTCGCCACGCCGTCGCTGCGGCACATCACCGTCTTTGAC
TATCATCCCGGTGTCGACGTGCAGCGCGAAAGTCTCGAATCCGCACAGCACCGGATCGCC
GAGGCCGGCCTGCCGATTTCGGTAGACCCGATACCCTGGCGATCGGGCACGGGCGCGCC
TTGCCGGATGCGCCGTTGTTCACCGCAGAGGAGGGTACCGACCCGCTGGCCCTGGTGATC
TACACCTCGGGAAGCACCGGAACTCCCAAGGGCGCCACCTATAGCGAAAAGATGGTCGCC
AAGCCCTGGCTGCGGGCCGACACGTTGAGCTCTAAGGCCGAAATTCCTTTGATCAACCTG

FIG. 8LL

```
AATTTCATGCCAATGAGCCATGTGATGGGACGCGGTAGTCTGGTCACTGCCCTGGCCTGC
GGCGGCCTGGCTTACTTTGCCGCGTCCAGCGACATGTCCACGCTGTTCGAAGACATCACG
CTTACGCGCCCCACCGTGGTGACACTCGTGCCCCGTGTGTGCGACATGCTTTTCCAGCGC
TACCGCAACGAGGTTGAACGCCGTACCGGGCTTGATCCGGCGGCCGACCTGGCCACCCTT
GATGCCGATGTCAAGACCGATATCCGCGAAAACCTGTTCGGCGGGCGTGTTCTGACAATC
GTGTGCGGCTCTGCCCCACTGTCCGAGGAACTGGCCGCCTTCATCGAATCCTGCCTCGAT
GCCCGTATCACCGATGGCTACGGCTCCACCGAGGCGGGCGTCATCGTGCGCAACGGCCGC
ATTCAGCGCCCGCCCGTCATCGACTACAAGCTGGTCGACGTGCCTGAGCTCGGTTACTTC
TCCACCGACAAGCCGCACCCGCGCGGCGAGCTGCTCGTGAAAGCCGAATCGGTGTTCGGC
GGCTACTTCAAACGCCCCGACGTCACCGCCGACGTATTCGATCCCGACGGGTACTACAAG
ACCGGGGACATCGTCGCCGAGCTCGAGCCCGACAAGATCCAGATCGTGGACCGGCGCAAC
AACGTGATCAAGCTGTCCCAGGGTGAGTTCGTGGCGATCGCCAACCTGGAAGCCGAGTTC
GCCAATAGTCCACTGGTGCATCAGATCTGCGTCTACGGCAGCAGCGAGCGGTCGTATCTG
CTAGCGGTGGTCGTGCCGACCGCTGAGGCATATGAACAAAGCGGTGGAGATGAGGATCTA
CTCAAACGCCTGATCGCGGACTCTCTCGCGCAGGTTGCCCGCGAGGCCCAACTGCAGTCC
TACGAGGTACCGCGCGACTTCCTGCTGGAGACCGAACCGTTCACCGCTGCCAACGGCCTA
CTGACCGGCATCGCGAAGCTGGCCCGACCGAAGCTCCATGAGAAGTACGGCGCCCGCCTG
GAGCAGCTGTACTCCGATATCGCCGCCGCCCAGGCGCTTGAGCTGCAAGCACTGCACTCT
GCCGGACATGAGGACAAGCCTGTCCTGGATACCGTGCAACGCGCGGTCACGGCGTTGTTG
GGGCTGTCGGCGGCCGAGGTGAGCCCAGACGCGCATTTCATCGACCTTGGTGGCGATTCA
CTATCCGCCCTTGCCTTCTCGGACCTGCTGCGCGATATCTTCACTGTGGAGGTTCCGGTT
GGCGATATCGTCAGCGCCGCCAACGATCTGACCGCTATCGCACGCATCGTGGAAAGACAC
CGGGAAGCAGACGGTCATTCGGTAACTCCCACCGCCGAATCCGTGCACGGTGCCGGGCAC
CGCGAGATCCGGGCCGCGGACCTGACGCTGGACAAGTTCATCGACGCGGACACCCTGCGC
GCGGCCCCGGCACTGTCCACATTCACCGGCACCCCGCACACGGTGCTGCTCACCGGCGCC
AACGGCTACCTGGGGCGGTTCCTGGCCCTGGAATGGCTTGAGCGCCTGGACAAGACAGAC
GGCAAGCTGATCGCCATCGTCCGCGGTAAGAATGCCGAGGCCGCCTACCGCCGCCTGGAG
GAAGCCTTCGACACCGGCGACACGCAGCTGTTGGCGCACTTCCGGTCGCTGGCCGACAAG
CACCTCGAAGTACTGGCCGGCGATATCGGCGACCCCAACCTTGGCCTGGATGCCGACACC
TGGCAGCGCCTGGCCGAGACCGTCGACGTCATCGTGCACCCCGCCGCCCTGGTCAACCAC
GTACTGCCCTACAGCCAGCTGTTCGGACCCAATGTCGTTGGCACCGCCGAAATCATCAAG
CTGGCACTCACCACCAAGATCAAGCCCATCACCTACCTCTCCACAGTGGCCGTGGCAATC
TCGGTGGACCCCAAGGTATTCGATGAAGACTCCGACATCCGCACGATCAGCGCGGTACGA
CCAATCAACGACGGCTACGCCAACGGATACGGCAACGCGAAATGGGCTGGCGAGGTACTG
CTGCGCGAAGCCCACGACCTGTGCGGACTACCCGTCGCGGTCTTCCGCTCCGACATGATC
TTGGCCCACAGCCGCTACACCGGACAGCTCAACGTGCCCGACCAGTTCACCCGACTAATC
CTCAGCCTCATCGCCACCGGAGTCGCACCCGGCTCCTTCTACCAAGCACACGCCACCGGC
GAACGCCCACTCGCCCACTACGACGGCCTGCCTGCGGATTTCACGGCATCGGCCATCACC
GCCCTCGGGCCCATCGAGGAGTTCCACACCTACGATTCGGTGAACCCGCATGCCGATGGG
ATCTCGCTGGACAACTTCGTCGACTGGCTCATCGAAGCCGGCTACCCCATCGCACGCATC
GACAACTACACCGAATGGTTCACCCGCTTCGACACCGCCATCCGAAGCCTCCCCGAAAAA
CAGAAACAACACTCCCTACTACCACTACTACACGCGTACAGGCATCCACAACACCCACAC
AACGGCGCATTCCTGCCCGCGATCAGGTTCAGTGAAGGCGTCCAGGCCCATCTGAACGCC
GACATCCCGCACCTCACGCGGGAACTCATCGCGAAATACGCGGCCGACCTGAAGCAGCTC
GGGTTACTCTAG
```

Amino acid sequence (SEQ ID NO:62)

>uniprot|B1MCS0|B1MCS0_MYCAB Probable fatty-acid-CoA ligase FadD

MTIDATADNTKEARRQRLGDRIRRLFTDDEQFRAAKPDTAVDTAVAQPGL
RLAQVVATIMNGYADRPALGHRVQELVADAAGRSTLRPLPEFETVTYGEL
WGMARALASTWYHDPAAPVRAGDFVAMLGFTSVDYTAVDLACIHLGAVAV
PLQTSASASNWTAILAESEPAVLAVSAELLDTAMESVLATPSLRIIITVFD

FIG. 8MM

```
YHPGVDVQRESLESAQHRIAEAGLPISVDPIPLAIGHGRALPDAPLFTAE
EGTDPLALVIYTSGSTGTPKGATYSEKMVAKPWLRADTLSSKAEIPLINL
NFMPMSHVMGRGSLVTALACGGLAYFAASSDMSTLFEDITLTRPTVVTLV
PRVCDMLFQRYRNEVERRTGLDPAADLATLDADVKTDIRENLFGGRVLTI
VCGSAPLSEELAAFIESCLDARITDGYGSTEAGVIVRNGRIQRPPVIDYK
LVDVPELGYFSTDKPHPRGELLVKAESVFGGYFKRPDVTADVFDPDGYYK
TGDIVAELEPDKIQIVDRRNNVIKLSQGEFVAIANLEAEFANSPLVHQIC
VYGSSERSYLLAVVVPTAEAYEQSGGDEDLLKRLIADSLAQVAREAQLQS
YEVPRDFLLETEPFTAANGLLTGIAKLARPKLHEKYGARLEQLYSDIAAA
QALELQALHSAGHEDKPVLDTVQRAVTALLGLSAAEVSPDAHFIDLGGDS
LSALAFSDLLRDIFTVEVPVGDIVSAANDLTAIARIVERHREADGHSVTP
TAESVHGAGHREIRAADLTLDKFIDADTLRAAPALSTFTGTPHTVLLTGA
NGYLGRFLALEWLERLDKTDGKLIAIVRGKNAEAAYRRLEEAFDTGDTQL
LAHFRSLADKHLEVLAGDIGDPNLGLDADTWQRLAETVDVIVHPAALVNH
VLPYSQLFGPNVVGTAEIIKLALTTKIKPITYLSTVAVAISVDPKVFDED
SDIRTISAVRPINDYANGYGNAKWAGEVLLREAHDLCGLPVAVFRSDMI
LAHSRYTGQLNVPDQFTRLILSLIATGVAPGSFYQAHATGERPLAHYDGL
PADFTASAITALGPIEEFHTYDSVNPHADGISLDNFVDWLIEAGYPIARI
DNYTEWFTRFDTAIRSLPEKQKQHSLLPLLHAYRHPQHPNGAFLPAIRF
SEGVQAHLNADIPHLTRELIAKYAADLKQLGLL
```

YP 001704097.1

Nucleotide sequence (SEQ ID NO:63)

>uniprot|B1MDX4|B1MDX4_MYCAB Putative fatty-acid-CoA ligase

```
ATGACGGCTGGTGCGGCGGCTCGCGTTGCCAAACTGTTCGAGTCCGATCCCCAATTCCGG
GCAGCCATGCCGGATCCAGCGGTGATGGACTCGCTGCTGGCGCCCGGCCTGCGTTTATCC
CAGGTACTCCACGCGTTGCTCAGCGGTTACGCGGAGCGCCCGGTGATGGGTTTCCGGTCC
CGCGAGTCGGTGGTCGACACCGCCACCGGCCGCACGGTCGACCGGCTGCTCCCTGCCTTT
GAAACCATCACCTATGGGCAACTCCTGGAAGACATCTCGGCCATCCTCGCGGAGTGGCAG
CATGGCGACATTCCCATGGGCGCCGGCGACTTCATCGCCACCATCGGCTTCTCCAGTCCC
GACTACGTCACCCTGGATCTGGCCACCCTCATGAATGGTTCGGTCTCGATCCCACTGCAG
CACAACACATCTGTGGCGCAGCTGCGGATGATGCTGGAGGAGACCAGCCCACGCCTGGTG
GCGGCGAGCGCGGACTGCCTGGATCTCGCGGTCGAGGCAGCTGTCGGGCTTACCGATCTG
CGACGGGTTGTGGTGTTCGATTACCGCGCCGAGACCGACGATCATCGCGAAAAACTGGCC
ACGGCAAGAGAACGCTTGCACGCGGCCGGTATGGACGTTGTAGTCGAACCGCTCGCAGAG
GTGATCGGGAGAGGACGAGACCTACCCGAACCCGTGCTGTACACGGCCGGGGACGATCAG
CGCACGGCCCTGATCATGTACACCTCCGGTAGCACCGGCGCGCCCAAGGGGGCGATGTTC
ACCGAGTGGACGGTGACCCGCTTCTGGTCCTCGGGCGCCGCCCCAACCGGGACACCCCG
ATCATCAACGTGAACTTCCTGCCGCTCAACCACCTTGCGGGCCGGGTAGGACTGCTGACG
GCCTTCATTCCCGGCGGCACATGCTACTTCGTCCCCGAGAGCGATCTGTCCACCCTGTTC
GAGGACTGGCAGCTGGCACGGCCCACCCATATGGGTGTGGTTCCCCGTGTCGTCGACATG
CTCTTCCAGCACTACCAAACGCGAGTGGACGCACTGATGGCCGGGGGAACCGACGTCGAC
ACCGCCGATCGGCTAGCCAAAACCGAACTGCGCGAAGATGTCCTGGGCGGGCGTGTGGTC
GCCGGCATGCTCGCCACCGCGCCGTTGTCCCCCGAGATGAAGGCTTTCCTGGAGTCCTCA
TTGGACTTTCATCTGCTTGATCTGTACGGCCTGACCGAGGTCGGCGGCGTGTTCGAGAC
GGCAAGATTTCCCGGCCGCCGGTGCTCGACTACAAGCTCGTCGATGTTCCTGAGCTCGGG
TACTACACCACCGACAAGCCCCATCCGCGTGGCGAATTGCTGGTCAAGAGTGCCACCGCA
ACGCCCGGCTACTACAAGCGTCCCGACGTCACCGCCGAGGTGTTCGACGCCGATGGCTAC
TACCGCACGGGCGATGTCATGGCGGAGGTCGCGCCGGACCAATTGGTGTACGTGGACAGG
CGCAATAACGTCATCAAGCTCGCCCAGGGCGAGTTCGTCGCGGTCGCCAATTTGGAAACG
```

FIG. 8NN

```
GTCTATGTGGGTGCGCCGCTGGTGCGCCAGATCTTCGTCTACGGCAACAGCGAACGCGCA
TACCTCCTCGCCGTTGTGGTGCCCACCGAGGAAGCCCTGCGGGCACACCCGGACCCCGTC
GAACTGAAGAATTCGATCCGGGAGTCACTGCAGCGGACCGCCCGCTCCAACCACCTGCAT
TCCTACGAGCTGCCCGCCGACTTCATTATCGAAACCACTCCATTCACGATCGAGAGTGGG
ATGCTTGCGGCTGTCGGTAAGCCGATACGTCCCAAGATGATCGAGCACTACGGCGACCGG
CTCGAGCAGCTCTACGTCGACCTCGCCGAGGCACGCGTCCAGGAACTGCGGCAGCTCCGC
GATACGGCGCAACAACGCCCGGTCCTCGATACCGTCACCGAGGCCGCCCAGGCCCTCCTC
GGCATGTCTGCGGACGCCGTCCGTCCCGACCACCACTTCATCGACCTCGGCGGAGATTCG
CTGTCCGCGTTGACATTCTCCAATCTTCTTCGAGACCTCTTCGACGTCGAGGTTCCGGTC
GGTGTGATCACCGGCCCGGCGGCCGATCTGCGCAAGCTCGCCGCTTACATCCAGCACGAA
CGGGAGCACAGCACCGCGACCGCTGCCAGCGTGCACGGGCTCGACACCACCGTCATCAGC
GCCACCGAACTGACACTCGACAAGTTCATCGACGCCGAGACACTCCACAACGCTTCGCAA
CTCGACGTGCCGGCGGGCGCGGTAGCTACCGTTCTGCTCACCGGCGCCAACGGATATCTC
GGAAGATTCCTCTGCCTGGAGTGGCTGCAACGGCTGTCCCAGACAGGTGGACAACTGATC
TGCCTGGTCCGCGGCGACAACGCCGATCAAGCCCTCGCGCGCCTCGTTGCCGCCTACGGC
GACACCGATCGCACACTGCTCGAGGAGTTCCACACCCTGGCTCGACGGCACCTGCGCGTG
ATCGCCGCCGATATCGCTCAGCCGCGCTTCGGCGTGGATGACGCCACCTGGGAGCAGCTG
GCCCGCGATGTCGACAAGATCGTGCATCCGGCCGCGCTGGTCAACCACGTGCTGCCCTAC
AACCAGCTGTTCGGCCCCAATGTGTTTGGCACGGCGGAGGTTATCCGGCTGGCCCTGACC
ACCCGGATCAAGCCGGTGACCTATCTGTCGACGATGGCCGTGGCCATGACCGTGCCCGAT
TTCGACGAGGACGGGGACATCCGCACGGTGAGTCCCACCCGGCATATCGACCCCGGCTAC
GCCAACGGGTACGCCAACAGCAAATGGGCCGGCGAGGTGCTGCTGCGGGAGGCACACGAC
ATATGCGGCCTGCCGGTCAGCGTGTTCCGGTCCGACATGATCCTGACGCACCGCCGTTAC
AGCGGACAACTCAACGTCACCGACGCCTTCACCCGCATGCTGCTGAGCCTGGTGCTCACC
GGCATCGCGCCGCGAAGCTTTTACCAAGGCGATGGCAGCGGTGCCCGCCCACGCGCTCAC
TACGAGGGGCTGCCGGTCGATTTCGTCACCGAAGCCATTACCAGCCTCGGCCTGTCCTCG
TCCGAGGGATTTCGCTCGTACGACGTCATGAATCCTCACGATGACGGCATTTCTGTGGAC
ACCTTTGTCGACTGGCTCATGGAAGATGGGCATTCCATCGACATCATCGACAACTACGAC
GAATGGCTGTCCCGTTTCGAGACGGCATTGCGAGGTCTGCCCGACGAGCAGCGGCGCGCC
TCAGTACTTCCGCTCCTCGATGCGTATCGGATACCGGGCAACCCGCGCCGTGCTGCCGCC
ACGCCCAATCATGTATTCCGGAAAGCCGTACAGGAGAACAACATCGGAGGTGACGGCGCC
GATATTCCGCAAATCGATCGTGCGCTGATCGCCAAATACATCGCCGATCTACGAGCACAC
AGGCTGCTGTGA
```

Amino acid sequence (SEQ ID NO:64)

>uniprot|B1MDX4|B1MDX4_MYCAB Putative fatty-acid-CoA ligase

```
MTAGAAARVAKLFESDPQFRAAMPDPAVMDSLLAPGLRLSQVLHALLSGY
AERPVMGFRSRESVVDTATGRTVDRLLPAFETITYGQLLEDISAILAEWQ
HGDIPMGAGDFIATIGFSSPDYVTLDLATLMNGSVSIPLQHNTSVAQLRM
MLEETSPRLVAASADCLDLAVEAAVGLTDLRRVVVFDYRAETDDHREKLA
TARERLHAAGMDVVVEPLAEVIGRGRDLPEPVLYTAGDDQRTALIMYTSG
STGAPKGAMFTEWTVTRFWSSGAAPNRDTPIINVNFLPLNHLAGRVGLLT
AFIPGGTCYFVPESDLSTLFEDWQLARPTHMGVVPRVVDMLFQHYQTRVD
ALMAGGTDVDTADRLAKTELREDVLGGRVVAGMLATAPLSPEMKAFLESS
LDFHLLDLYGLTEVGGVFRDGKISRPPVLDYKLVDVPELGYYTTDKPHPR
GELLVKSATATPGYYKRPDVTAEVFDADGYYRTGDVMAEVAPDQLVYVDR
RNNVIKLAQGEFVAVANLETVYVGAPLVRQIFVYGNSERAYLLAVVVPTE
EALRAHPDPVELKNSIRESLQRTARSNHLHSYELPADFIIETTPFTIESG
MLAAVGKPIRPKMIEHYGDRLEQLYVDLAEARVQELRQLRDTAQQRPVLD
TVTEAAQALLGMSADAVRPDHHFIDLGGDSLSALTFSNLLRDLFDVEVPV
GVITGPAADLRKLAAYIQHEREHSTATAASVHGLDTTVISATELTLDKFI
DAETLHNASQLDVPAGAVATVLLTGANGYLGRFLCLEWLQRLSQTGGQLI
```

FIG. 8OO

CLVRGDNADQALARLVAAYGDTDRTLLEEFHTLARRHLRVIAADIAQPRF
GVDDATWEQLARDVDKIVHPAALVNHVLPYNQLFGPNVFGTAEVIRLALT
TRIKPVTYLSTMAVAMTVPDFDEDGDIRTVSPTRHIDPGYANGYANSKWA
GEVLLREAHDICGLPVSVFRSDMILTHRRYSGQLNVTDAFTRMLLSLVLT
GIAPRSFYQGDGSGARPRAHYEGLPVDFVTEAITSLGLSSSEGFRSYDVM
NPHDDGISVDTFVDWLMEDGHSIDIIDNYDEWLSRFETALRGLPDEQRRA
SVLPLLDAYRIPGNPRRAAATPNHVFRKAVQENNIGGDGADIPQIDRALI
AKYIADLRAHRLL

YP 001705436.1

Nucleotide sequence (SEQ ID NO:65)

>uniprot|B1MLD7|B1MLD7_MYCAB Probable fatty-acid-coa ligase FadD

ATGACTGAAACGATCTCCACAGCGGCTGTCCCCACTACGGATCTCGAAGAGCAGGTGAAG
CGACGCATCGAGCAGGTCGTGTCCAACGATCCGCAGCTGGCGGCGCTTCTCCCGGAAGAT
TCGGTCACCGAGGCGGTCAACGAGCCCGATCTACCGCTGGTCGAGGTGATCAGGCGACTG
CTGGAGGGCTACGGTGACCGCCCGGCACTCGGCCAGCGCGCCTTCGAGTTCGTCACCGGG
GACGACGGTGCGACCGTGATCGCGCTGAAGCCCGAATACACCACCGTCTCCTACCGCGAG
TTGTGGGAACGTGCCGAGGCTATCGCTGCCGCGTGGCACGAGCAGGGCATCCGTGACGGC
GACTTCGTCGCTCAGTTGGGTTTCACCAGCACGGACTTCGCGTCGCTCGACGTCGCGGGA
TTGCGTCTGGGCACCGTCTCGGTGCCCCTGCAGACGGGCGCGTCGCTGCAGCAGCGCAAC
GCGATTCTCGAAGAGACCCGGCCCGCAGTCTTTGCCGCGAGTATCGAATACCTTGATGCC
GCCGTCGATTCGGTGCTTGCGACCCCCTCGGTGCGACTCCTCTCGGTTTTCGACTATCAC
GCGGAGGTCGACAGCCAGCGCGAAGCGCTGGAGGCTGTGCGGGCCCGGCTTGAGAGTGCC
GGCCGGACGATCGTCGTCGAGGCCCTGCGGAGGCTCTCGCGCGGGGCGGGACCTGCCC
GCCGCGCCGCTGCCCAGTGCAGATCCCGATGCCTTGCGTCTGCTCATCTACACCTCCGGC
AGCACCGGTACCCCCAAGGGCGCCATGTATCCGCAATGGCTGGTCGCCAACTTGTGGCAG
AAGAAGTGGCTCACCGACGATGTGATTCCGTCCATAGGCGTGAACTTCATGCCCATGAGC
CACCTGGCGGGTCGCCTCACTCTCATGGGCACCCTTTCCGGTGGCGGAACCGCCTACTAC
ATCGCTTCGAGCGATCTTTCGACTTTCTTCGAGGACATCGCGCTCATCCGCCCCTCCGAA
GTGCTCTTCGTGCCGCGTGTGGTGGAGATGGTGTTCCAGCGTTTTCAGGCAGAATTGGAC
CGGTCCCTTGCCCCGGGTGAGAGCAACTCCGAGATCGCGGAGCGAATCAAGGTCCGCATC
CGGGAACAGGACTTCGGCGGCGTGTGCTCAGTGCTGGCTCCGGGTCGGCCCCGTTGTCT
CCTGAGATGACGGAGTTCATGGAGTCGCTGCTGCAGGTGCCGTTGCGCGACGGGTATGGG
TCCACCGAGGCCGGTGGTGTGTGGCGTGACGGAGTCCTGCAGCGTCCGCCCGTCACCGAC
TACAAGCTGGTTGACGTTCCGGAACTCGGATACTTCACCACAGATTCGCCGCATCCCCGT
GGCGAGCTGCGGTTGAAGTCGGAGACGATGTTCCCCGGCTACTACAAGCGCCCGGAGACC
ACTGCCGATGTCTTCGATGACGAGGGGTACTACAAGACCGGTGACGTGGTCGCCGAGCTC
GGGCCGGATCACCTCAAGTACCTCGACCGCGTCAAGAACGTCCTCAAGCTCGCGCAGGGA
GAGTTTGTCGCGGTGTCAAAGCTGGAGGCCGCTTACACCGGCAGCCCGCTGGTCCGGCAG
ATCTTTGTGTACGGGAACAGTGAACGCTCGTTCCTGCTGGCTGTCGTGGTCCCGACACCC
GAAGTCCTTGAGCGGTACGCAGATTCGCCAGATGCGCTCAAGCCCTTGATCCAGGATTCG
CTGCAGCAGGTCGCCAAGGACGCGGAGCTGCAATCCTATGAGATACCGCGCGACTTCATC
GTTGAGACGGTGCCGTTCACCGTCGAGTCCGGATTGCTATCGGACGCGCGAAAGCTGCTG
CGCCCCAAGCTGAAGGATCACTACGGAGAGAGGCTGGAGGCGCTGTACGCCGAACTGGCG
GAAAGCCAGAATGAGCGGCTGCGCCAGTTGGCCAGGGAGGCAGCCACGCGCCCGGTCCTG
GAGACGGTGACCGATGCGGCCGCCGCGCTGCTGGGCGCATCGTCCTCGGATCTGGCTCCT
GATGTGCGATTCATCGACCTCGGTGGCGACTCACTGTCGGCGCTGTCGTACTCCGAGCTG
CTGCGCGACATCTTTGAGGTGGACGTTCCGGTGGGCGTCATCAACAGCGTCGCCAACGAC
CTTGCCGCGATCGCCCGGCACATCGAGGCGCAGCGGACCGGCGCCGCTACGCAGCCGACC
TTTGCGTCGGTCCACGGCAAGGACGCGACGGTCATCACCGCCGGTGAACTCACCCTCGAC

FIG. 8PP

```
AAGTTCTTGGACGAGTCACTGTTGAAAGCGGCCAAGGACGTTCAGCCGGCAACGGCCGAT
GTCAAGACCGTTCTAGTGACCGGCGGCAACGGCTGGTTGGGTCGTTGGCTGGTGCTCGAT
TGGCTGGAGCGGTTGGCACCCAATGGTGGCAAGGTCTACGCCCTCATTCGTGGCGCCGAT
GCCGAAGCAGCCCGGGCACGGTTGGACGCCGTGTACGAATCGGGTGATCCCAAGCTGTCC
GCGCATTATCGTCAGCTGGCGCAACAGAGTCTGGAAGTTATCGCCGGCGATTTCGGCGAC
CAGGATCTCGGTCTATCCCAGGAAGTTTGGCAGAAGCTGGCCAAGGACGTGGACCTGATC
GTGCACTCCGGTGCCTTGGTGAACCACGTGCTGCCGTACAGCCAGTTGTTCGGTCCGAAT
GTGGCGGGTACCGCCGAGATCATCAAGCTGGCAATTTCGGAGCGGCTCAAGCCGGTCACC
TACCTGTCGACGGTGGGCATCGCCGACCAGATTCCGGTGACGGAGTTCGAGGAAGACTCC
GATGTTCGTGTGATGTCGGCCGAGCGCCAGATCAATGACGGCTACGCGAACGGATACGGC
AACTCAAAATGGGCCGGCGAGGTGCTGTTGCGGGAGGCTCATGACCTAGCGGGGCTGCCG
GTGCGTGTGTTCCGCTCCGACATGATCCTGGCGCACAGTGACTACCACGGACAGCTCAAC
GTCACCGACGTGTTCACCCGGAGCATCCAGAGTCTGCTGCTCACCGGTGTTGCACCGGCC
AGCTTCTATGAATTGGATGCCGACGGCAATCGGCAGCGCGCTCACTATGACGGTGTGCCC
GGCGATTTCACCGCCGCATCGATCACCGCCATCGGCGGTGTGAACGTGGTAGACGGTTAC
CGCAGCTTCGACGTGTTCAACCCGCACCATGACGGTGTCTCGATGGATACCTTCGTCGAC
TGGCTGATCGACGCAGGCTACAAGATCGCGCGGATCGACGATTACGACCAGTGGCTCGCC
CGGTTCGAGCTGGCCCTCAAGGGATTGCCCGAGCAGCAGCGGCAACAGTCGGTGTTGCCA
CTTCTCAAGATGTACGAGAAGCCGCAACCGGCGATCGACGGAAGTGCACTTCCGACCGCA
GAATTCAGTCGCGCCGTGCACGAGGCGAAGGTCGGAGACAGCGGTGAGATACCGCACGTC
ACCAAGGAGCTGATCCTCAAGTACGCCAGCGATATTCAGCTGTTGGGCCTGGTGTAG
```

Amino acid sequence (SEQ ID NO:66)

>uniprot|B1MLD7|B1MLD7_MYCAB Probable fatty-acid-coa ligase FadD

```
MTETISTAAVPTTDLEEQVKRRIEQVVSNDPQLAALLPEDSVTEAVNEPD
LPLVEVIRRLLEGYGDRPALGQRAFEFVTGDDGATVIALKPEYTTVSYRE
LWERAEAIAAAWHEQGIRDGDFVAQLGFTSTDFASLDVAGLRLGTVSVPL
QTGASLQQRNAILEETRPAVFAASIEYLDAAVDSVLATPSVRLLSVFDYH
AEVDSQREALEAVRARLESAGRTIVVEALAEALARGRDLPAAPLPSADPD
ALRLLIYTSGSTGTPKGAMYPQWLVANLWQKKWLTDDVIPSIGVNFMPMS
HLAGRLTLMGTLSGGGTAYYIASSDLSTFFEDIALIRPSEVLFVPRVVEM
VFQRFQAELDRSLAPGESNSEIAERIKVRIREQDFGGRVLSAGSGSAPLS
PEMTEFMESLLQVPLRDGYGSTEAGGVWRDGVLQRPPVTDYKLVDVPELG
YFTTDSPHPRGELRLKSETMFPGYYKRPETTADVFDDEGYYKTGDVVAEL
GPDHLKYLDRVKNVLKLAQGEFVAVSKLEAAYTGSPLVRQIFVYGNSERS
FLLAVVVPTPEVLERYADSPDALKPLIQDSLQQVAKDAELQSYEIPRDFI
VETVPFTVESGLLSDARKLLRPKLKDHYGERLEALYAELAESQNERLRQL
AREAATRPVLETVTDAAAALLGASSSDLAPDVRFIDLGGDSLSALSYSEL
LRDIFEVDVPVGVINSVANDLAAIARHIEAQRTGAATQPTFASVHGKDAT
VITAGELTLDKFLDESLLKAAKDVQPATADVKTVLVTGGNGWLGRWLVLD
WLERLAPNGGKVYALIRGADAEAARARLDAVYESGDPKLSAHYRQLAQQS
LEVIAGDFGDQDLGLSQEVWQKLAKDVDLIVHSGALVNHVLPYSQLFGPN
VAGTAEIIKLAISERLKPVTYLSTVGIADQIPVTEFEEDSDVRVMSAERQ
INDGYANGYGNSKWAGEVLLREAHDLAGLPVRVFRSDMILAHSDYHGQLN
VTDVFTRSIQSLLLTGVAPASFYELDADGNRQRAHYDGVPGDFTAASITA
IGGVNVVDGYRSFDVFNPHHDGVSMDTFVDWLIDAGYKIARIDDYDQWLA
RFELALKGLPEQQRQQSVLPLLKMYEKPQPAIDGSALPTAEFSRAVHEAK
VGDSGEIPHVTKELILKYASDIQLLGLV
```

Nucleotide sequence (SEQ ID NO:67)

>uniprot|B1VMZ4|B1VMZ4_STRGG Putative carboxylic acid reductase

ATGGCCGAACCGCTGGACGCCGCCACCGCGTCGGCGCACGATCCGGGCCAGGGGCTCGCC
GAGGCCCTGGCCGCCGTCGAACCGGGCCGGGCGCTCGCCGAGGTCATGGCGTCCGTCCTG
GAGGGCCACGGGGACCGGCCCGCCCTCGGCGAACGGGCCCGGGAGCCGGAGACCGGGCGT
CTCCTCCCGCACTTCGACACCATCAGCTACCGCGAACTGTGGTCCCGCGTCCGTGCGCTG
GCCGGCCGGTGGCACCACGACCCGGAATACCCCCTGGGCCCCGGCGACCGGATCTGCACC
CTCGGCTTCACCAGCACCGACTACGCGACGCTCGACCTGGCGTGCATCCACCTGGGGGCC
GTGCCCGTCCCCCTCCCGTCCAACGCCCCGCTGCCCCGACTGGCGCCGGTCGTCGAGGAG
TCCGGGCCGACGGTACTGGCCGCGAGCGTCGACCGGCTCGACACCGCCATCGACGTCGTC
CTCGCGTCGAGCACGATCCGCCGCCTCCTCGTCTTCGACGACGGCCCGGGGGCCACCCGC
CCGGGCGGGGCACTGGCGGCCGCCCGCCAACGCCTGTCCGGCAGCCCGGTCACCGTCGAC
ACCCTGGCCGGACTCATCGACCGGGGCAGGGACCTGCCGCCCCCGCCCCTGTACATCCCG
GACCCGGGGGAGGACCCGCTCGCCCTGCTCATCTACACCTCCGGCAGCACCGGCGCGCCC
AAGGGCGCCATGTACACCCAACGGCTCCTGGGCACCGCGTGGTACGGGTTCAGCTACGGG
GCGGCCGACACCCCCGCGATCAGCGTCCTCTACCTGCCGCAGAGCCACCTCGCGGGCCGC
TACGCGGTGATGGGATCGCTCGTGAAGGGGGGCACCGGCTACTTCACCGCTGCCGACGAC
CTGTCCACCCTGTTCGAGGACATCGCCCTGGTCCGCCCCACGGAGCTGACCATGGTCCCG
CGCCTGTGCGACATGCTCCTCCAGCACTACCGGAGCGAACGGGACCGCCGGGCCGACGAA
CCGGGCGACATCGAGGCGGCGGTCACGAAGGCGGTGCGGGAGGACTTCCTGGGCGGGCGC
GTCGCCAAGGCGTTCGTCGGCACCGCGCCGCTCTCCGCCGAACTCACGGCGTTCGTCGAG
TCCGTCCTCGGCTTCCACCTCTACACCGGCTACGGCTCCACCGAAGCCGGCGGAGTGCTG
CTGGACACGGTGGTGCAGCGCCCTCCGGTCACCGACTACAAACTGGTCGACGTCCCCGAA
CTGGGCTACTACGCGACCGACCTGCCCCATCCGCGCGGCGAACTGCTGCTGAAGTCCCAC
ACGCTCATCCCCGGCTACTACCGGCGCCCCGACCTCACCGCCGCGATCTTCGACGCGGAC
GGCTACTACCGCACCGGTGACGTCTTCGCCGAGACCGGACCCGACCGGCTGGTCTACGTC
GACCGCACGAAGGACACCCTGAAGCTGTCCCAGGGCGAGTTCGTGGCCGTGTCCCGCCTG
GAGACCGTCCTCCTCGACAGCCCTCTCGTCCAGCACCTCTACCTGTACGGCAACAGCGAG
CGCGCCTACCTCCTCGCGGTGGTGGTGCCCACCCCGGACGCGCTGGCCGGGTGCGGCGGG
GACACCGAGGCGCTCAGGCCGCTGCTCATGGAATCCCTCCGCAGCGTCGCCAGGAGGGCC
GGGCTCAACGCGTACGAGATCCCGCGCGGCATCCTCGTCGAGCCCGAGCCCTTCAGCCCG
GAGAACGGCCTCTTCACCGAGAGCCACAAACTGCTGCGCCCCCGCCTCAAGGAGCGCTAC
GGGCCCGCTCTGGAGCTGCTGTACGACCGACTGGCCGACGGGCAGGACCGCCGGCTGCGC
GAGCTGCGGCGCACCGGTGCGGACCGGCCGGTGCAGGAGACGGTCCTCCGGGCCGCCCAG
GCCCTGCTGGGATCCCCGGGCTCCGACCTCCGGCCCGGCGCGCACTTCACCGACCTCGGC
GGGGACTCCCTCTCCGCCGTCTCGTTCTCCGAGCTGATGAAGGAGATCTTCCACGTCGAC
GTCCCGGTCGGTGCGATCATCGGCCCGGCCGCCGACCTGGCGGAGGTGGCGCGGTACATC
ACGGCGGCCCGTCGGCCGGCCGGGGCACCGCGGCCCACGCCCGCCTCCGTGCACGGGGAG
CACCGCACCGAAGTCCGCGCCGGGGACCTCGCCCCGGAGAAGTTCCTCGACGCGCCCACG
CTCGCCGCCGCTCCGGCGCTGCCCCGCCCCGACGGCGACGTCCGGACGGTCCTGCTGACC
GGCGCCACCGGCTACCTCGGCCGGTTCCTCTGCCTGGAGTGGCTGGAGCGGCTGGCGCCC
TCGGGCGGACGGCTGGTCTGCCTCGTCCGCGGCAGCGACGCGACCGTCGCGGCGAGGCGG
CTGGAGGCAGCCTTCGACAGCGGCGACACCGCCCTGCTCCGGCGCTACCGGAAGGCGGCC
GGGAAGACCCTGGACGTGGTCGCGGGGGACATCGGCGAACCACTGCTGGGCCTGGCGGAG
GAGACCTGGCGGAACTGGCCGGCGCCGTGGACCTGATCGTGCACCGGCCGCGCTGGTC
AACCACCTGCTGCCGTACGGCGAACTGTTCGGCCCCAACGTCGTCGGCACCGCCGAAGCG
ATCCGGCTGGCGCTCACCACCCGGCTGAAGCCCGTCAACCACGTCTCGACCGTCGCGGTC
TGCCTCGGCACCCCCGCCGAGACGGCCGACGAGAACGCCGACATCCGGGCCGCCGTCCCG
GTACGGACCACCGGCCAGGGGTACGCCGACGGATACGCGACCAGCAAATGGGCCGGCGAG

FIG. 8RR

```
GTCCTCCTGCGTGAGGCGCACGAGCGCTATGGCCTCCCCGTCGCCGTCTTCCGGTCCGAC
ATGGTCCTGGCGCACCGCACCTACACCGGACAGGTCAACGTCCCCGACGTCCTCACCCGG
CTGCTGCTCAGCCTGGTCGCCACCGGCATCGCCCCCGGCTCGTTCTACCGCACGGACACC
CGTGCCCACTACGACGGCCTGCCGGTCGACTTCACCGCGGAGGCCGTCGTCGCGCTGGGC
GCACCGATCACCGAGGGCCACCGGACCTTCAACGTCCTCAACCCGCACGACGACGGCGTT
TCCCTGGACACCTTCGTCGACTGGCTCATCGAGGCCGGCCACCCGATCCGGCGGATCGAC
GACCACGGTGCCTGGCTCACCCGCTTCACCGCGGCGCTCCGCGCCCTGCCGGAGAAGCAG
CGGCAGCACTCCCTGCTCCCGCTGATCGGCGCCTGGGCGGAACCCGGCGAAGGAGCCCCC
GGGCCGCTGCTCCCCGCCCGGCGCTTCCACGCCGCCGTCCGGGCGGCGGGGTCGGCCCC
GAGCGGGACATTCCCCGGGTGTCGCCGGACCTCATCCGCAAGTACGTCACCGACCTGCGC
GCACTCGGGCTCCTCGCCGGCCCCTGA
```

Amino acid sequence (SEQ ID NO:68)

>uniprot|B1VMZ4|B1VMZ4_STRGG Putative carboxylic acid reductase

```
MAEPLDAATASAHDPGQGLAEALAAVEPGRALAEVMASVLEGHGDRPALG
ERAREPETGRLLPHFDTISYRELWSRVRALAGRWHHDPEYPLGPGDRICT
LGFTSTDYATLDLACIHLGAVPVPLPSNAPLPRLAPVVEESGPTVLAASV
DRLDTAIDVVLASSTIRRLLVFDDGPGATRPGGALAAARQRLSGSPVTVD
TLAGLIDRGRDLPPPPLYIPDPGEDPLALLIYTSGSTGAPKGAMYTQRLL
GTAWYGFSYGAADTPAISVLYLPQSHLAGRYAVMGSLVKGGTGYFTAADD
LSTLFEDIALVRPTELTMVPRLCDMLLQHYRSERDRRADEPGDIEAAVTK
AVREDFLGGRVAKAFVGTAPLSAELTAFVESVLGFHLYTGYGSTEAGGVL
LDTVVQRPPVTDYKLVDVPELGYYATDLPHPRGELLLKSHTLIPGYYRRP
DLTAAIFDADGYYRTGDVFAETGPDRLVYVDRTKDTLKLSQGEFVAVSRL
ETVLLDSPLVQHLYLYGNSERAYLLAVVVPTPDALAGCGGDTEALRPLLM
ESLRSVARRAGLNAYEIPRGILVEPEPFSPENGLFTESHKLLRPRLKERY
GPALELLYDRLADGQDRRLRELRRTGADRPVQETVLRAAQALLGSPGSDL
RPGAHFTDLGGDSLSAVSFSELMKEIFHVDVPVGAIIGPAADLAEVARYI
TAARRPAGAPRPTPASVHGEHRTEVRAGDLAPEKFLDAPTLAAAPALPRP
DGDVRTVLLTGATGYLGRFLCLEWLERLAPSGGRLVCLVRGSDATVAARR
LEAAFDSGDTALLRRYRKAAGKTLDVVAGDIGEPLLGLAEETWRELAGAV
DLIVHPAALVNHLLPYGELFGPNVVGTAEAIRLALTTRLKPVNHVSTVAV
CLGTPAETADENADIRAAVPVRTTGQGYADGYATSKWAGEVLLREAHERY
GLPVAVFRSDMVLAHRTYTGQVNVPDVLTRLLLSLVATGIAPGSFYRTDT
RAHYDGLPVDFTAEAVVALGAPITEGHRTFNVLNPHDDGVSLDTFVDWLI
EAGHPIRRIDDHGAWLTRFTAALRALPEKQRHSLLPLIGAWAEPGEGAP
GPLLPARRFHAAVRAAGVGPERDIPRVSPDLIRKYVTDLRALGLLAGP
```

YP_001851230.1

Nucleotide sequence (SEQ ID NO:69)

>uniprot|B2HE95|B2HE95_MYCMM Fatty-acid-CoA ligase FadD9_1

```
TTGTCAATTACCTGTGTGGATACCCGTGCACAGCGGAGCGCCCGTCGCATCGAGCAGCTT
TACTCCACCGATGCGCAATTCGCCGCCGCCCGGCCCAGTACGGCGGTCGGTATCGCAATC
AGCAAGTCCGGGTTGGGATTACCACAGATCATTCAAACGGTGATGGACGGATACCCGCAA
CGTCCGGCACTTGGGCAGCGGGCGACGCGCGTTGTTACCGATCCGAATACCGGGCGTAGC
TCGGCGCAGCTGTTGGCGGAGTTCGAGACCATCACCTACCGGGAGTTGTGGAACCGCACC
AATGCATTGACCAACGCATTCGCCGCCGAGGCACTTGCGGATCGCGGTCAGCGGGTCTGT
GTGCTGGGATTCGCGAGCATCGACTACGCCACCATCGACTTGGCGCTGATGTTGCTCGGC
```

FIG. 8SS

```
GCGGTATCGGTTCCGTTGCCGACGAATGCGGCTCGCGCCCAGCTGTGCCATATCGTCTCC
GAGACCCAGCCCAGCCTGATCGCCTCGAGTACCGAAAACCTGCCCGATGCAATCTCTTTG
GTGCTGTCGCACCGCGCACCACACCGGGTGGTGGTGTTCGACTACCGCCCCGAACTCGAC
GCACACCGCGAAGCCCTCGAAGCCGCTCGCGCGCGCCTGGCCGCCATCCCGGTGACCGTC
GAAACGCTCACCGCCATCATCGCGCGCGGTCGAACGGTGCGGCCGGCCGAGGCCGATTGC
GGCGCCCAGTCCGCTGATGCACCGGCGCTTTTGATCTATACCTCCGGAAGCACCGGGGCA
CCCAAGGGCGTCGTCTACACCCGCAACCGGGTGGCGGACTTCTGGCGCACCTCGAAAGCC
GAGGTCGAAGCGACCGAACAACGAACCGCTCCTTCGATCACCCTCAACTTCATGCCGATG
AGCCACGCGAACGGCCGCCAGGTGCTCTACGGGACGCTGTCCAACGGCGGCACCGCGTAT
TTCACGGCCCGCAGCGACCTCTCGACGCTCTTCGATGATCTCGCGTTGGTCCGGCCCACC
GAATTGGGCTTTCCACCGCGCATTTGGGACATGCTGTTGGAGAGGTTTGGGCGCGAAGTC
GACCGTCGGCTCCGGGACGGCACAGCCGAGGGCGCCGACCCGGGCGCGCTGAAGGCTCGC
GTGGCGGCCGACCTACGCCAGGTGCTGCTCGGCGGACGGTATGCGCTGGCGATGATGGGC
TCCGCGCCAATCTCCGAGCAGATGAAAGCATCCGTCGAATCCCTGCTCGATCTGGACGTC
ATGGAGGGCTATGGCTCCACGGAAGCCGGAACGGTCATCATCAACAACGAGGTTCAGCGT
CCCCAGGTGATCGACTACAAGCTGGTCGACGTTGCGGAACTGGGCTATTTCCTTACCGAC
CGGCCATATCCGCGGGGCGAACTGCTGGTCAAAACGCGGACACTGTTTTCCGGCTACTAC
CGGGACCCCGAAGACGGCGCCCAGGTCTTCGACCCGGACGGCTTCTACCGGACCGGCGAC
ATCATGGCCCAAGTCGGCCCCGATCGGCTCGCCTACCTCGACCGGCGCAACAACGTGCTG
AAGCTGTCGCAGGGGGAGTTCGTCGCGGTCTCGCGACTAGAAGCAATATTTGCCAATAGC
CCGTTGGTCCGGCAGATCTTCGTCTATGCCAACGGTGCTCGCGCCTACCCACTGGCGGTA
GTCGTGCCCACCCAGGACGCACAGTCGCGCCACGGTCGCGCCGAACTCAAGGCCGAACTC
CATACATCGCTGCACCGCGTTGCCATGTCGGCCGGTCTGGCACCCTACGAGATCCCACGC
GACTTCATTGTCGAGACAACCCCCTTCACGCCGCAGAACGGCCTGCTCACCGCAATCCAC
AAGCTGGCCCGGCCGCACCTCACGCAGCGCTATGGCGCACGTCTGGAGCTGCTGTACACC
GAGCTGGCCGACAGCCAGACCCGCCGGCTGCACCGATTGCGCCAAACCGGTGGGCGGCTG
CCGGCGCTCGAGACCATCAGGCGTGCCGCCGGGGCACTGTTGGGCACGGAGACCACCGAG
CCGCGGCCCGAGGCCCACTTCAAAGATCTGGGCGGGATTCGGTATCGGCGGTGACGTTC
TCCAACCTGCTACACGACATCTACGGTTTCGATGTTCCGGTCGGTGTGATCCTCGGCCCG
GCAACCGATTTGCGGGCGCTGGCCAGCCACGTCGAGAGCCGGCGCGGTGCCGGATGGTCG
GGGCCCAGCTTCGCGTCGGTGCACGTGCCCCGGGCGACCTCGGTACACGCCGGCGACCTG
AAACTGGCCAAGTTCCTGGACACCAAGACACTCGCAGCTGCCACGAGCCTGCCCGCTGCC
GATGCCCGGGCACGGACGGTGCTACTCACCGGCGCAACCGGATTCCTGGGACGCTACCTG
GTGCTGGAATGGCTGCGCCGGTTGCGGGCCGTCGGCGGCAAGCTGATCTGTCTGGTGCGC
GCCGCGTCCGACGAACAAGCCCGGGTTCGGCTGGATACGGCCTTCGATAGCGGCGATCCG
CAGCTGCCCGAGCACTTTCGGCAGCTCGCTGTCGACCGCCTGGAGGTCCTCGCCGGCGAT
AAGAGCGAACCAGGTCTCGGTCTGGACGGCCCAACCTGGCAGCGACTGGCCGACACGGTC
GACCTGATCGTCGACCCCGCCACGCTGGTCAACCACGTGCTGTCGTACCGGCAGCTGTTC
GCTCCCAACGTGGCGGGCACCGCCGAGTTGCTCCGCCTCGCACTCACCACCAAACGCAAG
CCCTATGCCTACGTCTCGACCGTCAGCGTGGCCAACCAGATCGAACCGTCCGCATTCACC
GAAGACGCCGACATCCGGGAGATCAGCCGCACCCGAACCATCGATGACAGCTTTGCCAAC
GGCTACACCACCAGCAAGTGGGCCAGCGAGGTGCTGTTGCGTGAGGCTCACGATCTGTGC
GGACTGCCGGTCACGGTCTTTCGTTGCGACATGATCCTGGCGGACACCAGCTACGCCGGC
CAGCTCAACCTCGCCGATACCTTCACCCGGCTGATGCTCAGTGTGGCGGCCACCGGGATC
GCGCCCGCCTCGTTCTACCGGCTGGGCCCGACGGCAAACGCCAGCCCGCCCACTTCGAC
GGATTGCCCGTCGAATTCATCGCCGAGGCGGTGGCCACCCTGGGGCGCGGCGCCACGAC
GGGTTCCAGGTCCACCATGTGGCGAATCCGCACCACGACGGCGTTGGGTTGGACGAGTAC
GTCGACTGGCTAGTCGATGCCGGTTGCCCCATCCGGCGCATTCCCGACTATGACGAGTGG
CTGAGTCGATTCGAGACGGCGCTGCACGCGCTGCCGGATCGCAAGCGTCGTCATTCACTG
CTTCCGCTGCTGCAGAACTATCGAGAACCCGCCGAGCCGATCCGGGGCGGCATCGCGCCC
GCACCACGGTTTCGCGGTGCGGTACGGCAGGCGAAAATCGGCCGCGACAACGACATTCCC
CATGTCGGCCCGGCGATCATCGCCAAGTACGCCAGCGACCTGCAGCTTCTCGGCCTGGCT
TGA
```

FIG. 8TT

Amino acid sequence (SEQ ID NO:70)

>uniprot|B2HE95|B2HE95_MYCMM Fatty-acid-CoA ligase FadD9_1

MSITCVDTRAQRSARRIEQLYSTDAQFAAARPSTAVGIAISKSGLGLPQI
IQTVMDGYPQRPALGQRATRVVTDPNTGRSSAQLLAEFETITYRELWNRT
NALTNAFAAEALADRGQRVCVLGFASIDYATIDLALMLLGAVSVPLPTNA
ARAQLCHIVSETQPSLIASSTENLPDAISLVLSHRAPHRVVVFDYRPELD
AHREALEAARARLAAIPVTVETLTAIIARGRTVRPAEADCGAQSADAPAL
LIYTSGSTGAPKGVVYTRNRVADFWRTSKAEVEATEQRTAPSITLNFMPM
SHANGRQVLYGTLSNGGTAYFTARSDLSTLFDDLALVRPTELGFPPRIWD
MLLERFGREVDRRLRDGTAEGADPGALKARVAADLRQVLLGGRYALAMMG
SAPISEQMKASVESLLDLDVMEGYGSTEAGTVIINNEVQRPQVIDYKLVD
VAELGYFLTDRPYPRGELLVKTRTLFSGYYRDPEDGAQVFDPDGFYRTGD
IMAQVGPDRLAYLDRRNNVLKLSQGEFVAVSRLEAIFANSPLVRQIFVYA
NGARAYPLAVVVPTQDAQSRHGRAELKAELHTSLHRVAMSAGLAPYEIPR
DFIVETTPFTPQNGLLTAIHKLARPHLTQRYGARLELLYTELADSQTRRL
HRLRQTGGRLPALETIRRAAGALLGTETTEPRPEAHFKDLGGDSVSAVTF
SNLLHDIYGFDVPVGVILGPATDLRALASHVESRRGAGWSGPSFASVHVP
RATSVHAGDLKLAKFLDTKTLAAATSLPAADARARTVLLTGATGFLGRYL
VLEWLRRLRAVGGKLICLVRAASDEQARVRLDTAFDSGDPQLPEHFRQLA
VDRLEVLAGDKSEPGLGLDGPTWQRLADTVDLIVDPATLVNHVLSYRQLF
APNVAGTAELLRLALTTKRKPYAYVSTVSVANQIEPSAFTEDADIREISR
TRTIDDSFANGYTTSKWASEVLLREAHDLCGLPVTVFRCDMILADTSYAG
QLNLADTFTRLMLSVAATGIAPASFYRLGPDGKRQPAHFDGLPVEFIAEA
VATLGARRHDGFQVHHVANPHHDGVGLDEYVDWLVDAGCPIRRIPDYDEW
LSRFETALHALPDRKRRHSLLPLLQNYREPAEPIRGGIAPAPRFRGAVRQ
AKIGRDNDIPHVGPAIIAKYASDLQLLGLA

YP_001850422.1

Nucleotide sequence (SEQ ID NO:71)

>uniprot|B2HN69|B2HN69_MYCMM Fatty-acid-CoA ligase FadD9

ATGTCGCCAATCACGCGTGAAGAGCGGCTCGAGCGCCGCATCCAGGACCTCTACGCCAAC
GACCCGCAGTTCGCCGCCGCCAAACCCGCCACGGCGATCACCGCAGCAATCGAGCGGCCG
GGTCTACCGCTACCCCAGATCATCGAGACCGTCATGACCGGATACGCCGATCGGCCGGCT
CTCGCTCAGCGCTCGGTCGAATTCGTGACCGACGCCGGCACCGGCCACACCACGCTGCGA
CTGCTCCCCACTTCGAAACCATCAGCTACGGCGAGCTTTGGGACCGCATCAGCGCACTG
GCCGACGTGCTCAGCACCGAACAGACGGTGAAACCGGGCGACCGGGTCTGCTTGTTGGGC
TTCAACAGCGTCGACTACGCCACGATCGACATGACTTTGGCGCGGCTGGGCGCGGTGGCC
GTACCACTGCAGACCAGCGCGGCGATAACCCAGCTGCAGCCGATCGTCGCCGAGACCCAG
CCCACCATGATCGCGGCCAGCGTCGACGCACTCGCTGACGCCACCGAATTGGCTCTGTCC
GGTCAGACCGCTACCCGAGTCCTGGTGTTCGACCACCACCGGCAGGTTGACGCACACCGC
GCAGCGGTCGAATCCGCCCGGGAGCGCCTGGCCGGCTCGGCGGTCGTCGAAACCCTGGCC
GAGGCCATCGCGCGCGGCGACGTGCCCCGCGGTGCGTCCGCCGGCTCGGCGCCCGGCACC
GATGTGTCCGACGACTCGCTCGCGCTACTGATCTACACCTCGGGCAGCACGGGTGCGCCC
AAGGGCGCGATGTACCCCGACGCAACGTTGCGACCTTCTGGCGCAAGCGCACCTGGTTC
GAAGGCGGCTACGAGCCGTCGATCACGCTGAACTTCATGCCAATGAGCCACGTCATGGGC
CGCCAAATCCTGTACGGCACGCTGTGCAATGGCGGCACCGCCTACTTCGTGGCGAAAAGC
GATCTCTCCACCTTGTTCGAAGACCTGGCGCTGGTGCGGCCCACCGAGCTGACCTTCGTG

FIG. 8UU

```
CCGCGCGTGTGGGACATGGTGTTCGACGAGTTTCAGAGTGAGGTCGACCGCCGCCTGGTC
GACGGCGCCGACCGGGTCGCGCTCGAAGCCCAGGTCAAGGCCGAGATACGCAACGACGTG
CTCGGTGGACGGTATACCAGCGCACTGACCGGCTCCGCCCCTATCTCCGACGAGATGAAG
GCGTGGGTCGAGGAGCTGCTCGACATGCATCTGGTCGAGGGCTACGGCTCCACCGAGGCC
GGGATGATCCTGATCGACGGAGCCATTCGGCGCCCGGCGGTACTCGACTACAAGCTGGTC
GATGTTCCCGACCTGGGTTACTTCCTGACCGACCGGCCACATCCGCGGGGCGAGTTGCTG
GTCAAGACCGATAGTTTGTTCCCGGGCTACTACCAGCGAGCCGAAGTCACCGCCGACGTG
TTCGATGCTGACGGCTTCTACCGGACCGGCGACATCATGGCCGAGGTCGGCCCCGAACAG
TTCGTGTACCTCGACCGCCGCAACAACGTGTTGAAGCTGTCGCAGGGCGAGTTCGTCACC
GTCTCCAAACTCGAAGCGGTGTTTGGCGACAGCCCACTGGTACGGCAGATCTACATCTAC
GGCAACAGCGCCCGTGCCTACCTGTTGGCGGTGATCGTCCCCACCCAGGAGGCGCTGGAC
GCCGTGCCTGTCGAGGAGCTCAAGGCGCGGCTGGGCGACTCGCTGCAAGAGGTCGCAAAG
GCCGCCGGCCTGCAGTCCTACGAGATCCCGCGCGACTTCATCATCGAAACAACACCATGG
ACGCTGGAGAACGGCCTGCTCACCGGCATCCGCAAGTTGGCCAGGCCGCAGCTGAAAAAG
CATTACGGCGAGCTTCTCGAGCAGATCTACACGGACCTGGCACACGGCCAGGCCGACGAA
CTGCGCTCGCTGCGCCAAAGCGGTGCCGATGCGCCGGTGCTGGTGACGGTGTGCCGTGCG
GCGGCCGCGCTGTTGGGCGGCAGCGCCTCTGACGTCCAGCCCGATGCGCACTTCACCGAT
TTGGGCGGCGACTCGCTGTCGGCGCTGTCGTTCACCAACCTGCTGCACGAGATCTTCGAC
ATCGAAGTGCCGGTGGGCGTCATCGTCAGCCCCGCCAACGACTTGCAGGCCCTGGCCGAC
TACGTCGAGGCGGCTCGCAAACCCGGCTCGTCACGGCCGACCTTCGCCTCGGTCCACGGC
GCCTCGAATGGGCAGGTCACCGAGGTGCATGCCGGTGACCTGTCCCTGGACAAATTCATC
GATGCCGCAACCCTGGCCGAAGCTCCCCGGCTGCCCGCCGCAAACACCCAAGTGCGCACC
GTGCTGCTGACCGGCGCCACCGGCTTCCTCGGGCGCTACCTGGCCCTGGAATGGCTGGAG
CGGATGGACCTGGTCGACGGCAAACTGATCTGCCTGGTCCGGGCCAAGTCCGACACCGAA
GCACGGGCGCGGCTGGACAAGACGTTCGACAGCGGCGACCCCGAACTGCTGGCCCACTAC
CGCGCACTGGCCGGCGACCACCTCGAGGTGCTCGCCGGTGACAAGGGCGAAGCCGACCTC
GGACTGGACCGGCAGACCTGGCAACGCCTGGCCGACACGGTCGACCTGATCGTCGACCCC
GCGGCCCTGGTCAACCACGTACTGCCATACAGCCAGCTGTTCGGGCCCAACGCGCTGGGC
ACCGCCGAGCTGCTGCGGCTGGCGCTCACCTCCAAGATCAAGCCCTACAGCTACACCTCG
ACAATCGGTGTCGCCGACCAGATCCCGCCGTCGGCGTTCACCGAGGACGCCGACATCCGG
GTCATCAGCGCCACCCGCGCGGTCGACGACAGCTACGCCAATGGCTACTCGAACAGCAAG
TGGGCCGGCGAGGTGCTGTTGCGCGAGGCGCATGACCTGTGTGGCCTGCCGGTTGCGGTG
TTCCGCTGCGACATGATCCTGGCCGACACCACATGGGCGGGACAGCTCAATGTGCCGGAC
ATGTTCACCCGGATGATCCTGAGCCTGGCGGCCACCGGTATCGCGCCGGGTTCGTTCTAT
GAGCTTGCGGCCGACGGCGCCCGGCAACGCGCCCACTATGACGGTCTGCCCGTCGAGTTC
ATCGCCGAGGCGATTTCGACTTTGGGTGCGCAGAGCCAGGATGGTTTCCACACGTATCAC
GTGATGAACCCCTACGACGACGGCATCGGACTCGACGAGTTCGTCGACTGGCTCAACGAG
TCCGGTTGCCCCATCCAGCGCATCGCTGACTATGGCGACTGGCTGCAGCGCTTCGAAACC
GCACTGCGCGCACTGCCCGATCGGCAGCGGCACAGCTCACTGCTGCCGCTGTTGCACAAC
TATCGGCAGCCGGAGCGGCCCGTCCGCGGGTCGATCGCCCCTACCGATCGCTTCCGGGCA
GCGGTGCAAGAGGCCAAGATCGGCCCCGACAAAGACATTCCGCACGTCGGCGCGCCGATC
ATCGTGAAGTACGTCAGCGACCTGCGCCTACTCGGCCTGCTCTGA
```

Amino acid sequence (SEQ ID NO:72)

>uniprot|B2HN69|B2HN69_MYCMM Fatty-acid-CoA ligase FadD9

MSPITREERLERRIQDLYANDPQFAAAKPATAITAAIERPGLPLPQIIET
VMTGYADRPALAQRSVEFVTDAGTGHTTLRLLPHFETISYGELWDRISAL
ADVLSTEQTVKPGDRVCLLGFNSVDYATIDMTLARLGAVAVPLQTSAAIT
QLQPIVAETQPTMIAASVDALADATELALSGQTATRVLVFDHHRQVDAHR
AAVESARERLAGSAVVETLAEAIARGDVPRGASAGSAPGTDVSDDSLALL
IYTSGSTGAPKGAMYPRRNVATFWRKRTWFEGGYEPSITLNFMPMSHVMG
RQILYGTLCNGGTAYFVAKSDLSTLFEDLALVRPTELTFVPRVWDMVFDE

FIG. 8VV

```
FQSEVDRRLVDGADRVALEAQVKAEIRNDVLGGRYTSALTGSAPISDEMK
AWVEELLDMHLVEGYGSTEAGMILIDGAIRRPAVLDYKLVDVPDLGYFLT
DRPHPRGELLVKTDSLFPGYYQRAEVTADVFDADGFYRTGDIMAEVGPEQ
FVYLDRRNNVLKLSQGEFVTVSKLEAVFGDSPLVRQIYIYGNSARAYLLA
VIVPTQEALDAVPVEELKARLGDSLQEVAKAAGLQSYEIPRDFIIETTPW
TLENGLLTGIRKLARPQLKKHYGELLEQIYTDLAHGQADELRSLRQSGAD
APVLVTVCRAAAALLGGSASDVQPDAHFTDLGGDSLSALSFTNLLHEIFD
IEVPVGVIVSPANDLQALADYVEAARKPGSSRPTFASVHGASNGQVTEVH
AGDLSLDKFIDAATLAEAPRLPAANTQVRTVLLTGATGFLGRYLALEWLE
RMDLVDGKLICLVRAKSDTEARARLDKTFDSGDPELLAHYRALAGDHLEV
LAGDKGEADLGLDRQTWQRLADTVDLIVDPAALVNHVLPYSQLFGPNALG
TAELLRLALTSKIKPYSYTSTIGVADQIPPSAFTEDADIRVISATRAVDD
SYANGYSNSKWAGEVLLREAHDLCGLPVAVFRCDMILADTTWAGQLNVPD
MFTRMILSLAATGIAPGSFYELAADGARQRAHYDGLPVEFIAEAISTLGA
QSQDGFHTYHVMNPYDDGIGLDEFVDWLNESGCPIQRIADYGDWLQRFET
ALRALPDRQRHSSLLPLLHNYRQPERPVRGSIAPTDRFRAAVQEAKIGPD
KDIPHVGAPIIVKYVSDLRLLGLL
```

O69484

Nucleotide sequence (SEQ ID NO:73)

```
>uniprot|O69484|O69484_MYCLE Putative Acyl-CoA synthetase

ATGTCGACTATCACTAAGCAGGAAAAGCAGCTCGCACGCCGCGTTGACGACCTCACCGCC
AACGACCCGCAGTTCGCCGCCGCCAAACCCGACCCGGCGGTAGCCGCCGCCCTTGCCCAG
CCCGGGCTTCGACTGCCCCAAATCATCCAGACCGCGCTGGACGGTTACGCGGAGCGGCCG
GCACTGGGCCAGCGCGTCGCCGAGTTCACCAAAGACCCTAAGACCGGACGCACCTCGATG
GAGCTGCTCCCCAGCTTTGAGACCATCACCTACCGCCAGTTGGGCGACCGTGTCGGAGCG
CTGGCGCGCGCCTGGAGGCACGACCTACTGCACGCCGGCTACCGGGTCTGCGTGCTAGGT
TTCAACAGTGTCGATTACGCCATCATCGACATGGCGCTCGGCGTGATTGGTGCTGTGGCG
GTTCCACTGCAGACCAGTGCGGCGATCACCCAGCTGCAGTCGATCGTGACCGAGACCGAA
CCCAGTATGATCGCGACGAGCGTAAACCAGCTGCCCGATACTGTCGAGCTGATCCTGTCT
GGCCAGGCGCCAGCGAAGCTCGTTGTGTTTGACTACCACCCCGAGGTCGACGAGCAGCAT
GACGCAGTGGCAACCGCCCGGGCGCGGTTGGCGGACAGTAGCGTGGTGGTCGAGAGCCTG
ACCGAGGTCCTCGGTCGCGGCAAGACGCTGCCAGCTACGCCGATCCCCGTGGCCGATGAC
TCTGCTGACCCGTTGGCGTTGCTGATCTACACATCTGGCAGCACCGGCGCACCCAAGGGC
GCGATGTATCTGCAAAGCAATGTCGGCAAGATGTGGCGCCGGTCAGACGGAAACTGGTTC
GGGCCAACCGCCGCGTCAATCACTCTTAACTTCATGCCGATGAGCCACGTCATGGGCCGC
GGAATCCTCTACGGCACGCTCGGTAACGGCGGCACGGCTTACTTCGCCGCCCGCAGCGAC
CTCTCGACGCTGCTGGAGGATCTCAAGCTGGTGCGGCCGACCGAGTTGAACTTTGTACCG
CGCATCTGGGAAACCCTCTACGATGAATCCAAACGCGCAGTTGACCGTCGGTTAGCCAAC
AGCGGCTCCGCCGACCGTGCAGCCATCAAAGCCGAAGTTATGGATGAACAGCGGCAATCC
CTGCTGGGAGGACGGTACATCGCGGCTATGACGGGCTCGGCGCCAACCTCCCCGGAGTTG
AAACACGGGGTCGAGTCCCTACTCGAAATGCATCTGTTGGAAGGCTACGGCTCCACCGAA
GCCGGCATGGTCTTGTTTGACGGCGAAGTGCAACGTCCGCCGGTTATCGATTACAAGCTG
GTCGACGTTCCGGATTTGGGCTACTTCAGCACCGACCAGCCTTATCCGAGAGGTGAATTG
CTGCTCAAGACCCAGAACATGTTCCCCGGCTACTACAAGCGTCCTGAGGTTACCGCCACC
GTGTTCGACAGCGACGGTTACTACCAGACCGGAGACATTGTCGCCGAAGTCGGTCCCGAC
CGGCTCGTGTACGTCGATCGCCGCAACAACGTGCTGAAACTCGCGCAGGGCCAGTTCGTC
ACCGTCGCGAAACTCGAGGCAGCGTTCAGCAATAGCCCACTGGTCCGGCAGATCTACATC
TATGGCAACAGCGCACACCCCTACCTGTTGGCTGTTGTGGTGCCGACCGAGGATGCGTTG
GCTACCAATGACATTGAGGTGCTCAAACCGCTGATTATCGATTCTTTACAGAAAGTAGCG
```

FIG. 8WW

```
AAAGAAGCCGACCTGCAGTCCTACGAGGTGCCGCGCGACTTAATCGTCGAGACTACACCG
TTCAGCCTGGAGAATGGCCTGCTCACCGGTATTCGCAAGCTGGCGTGGCCGAAGCTCAAG
CAGCACTACGGCGCGCGACTCGAACAGCTCTACGCCGATCTGGTTGAAGGTCAGGCAAAT
GCACTGCACGTGCTAAAACAAAGCGTGGCGAACGCTCCGGTACTGCAGACGGTGAGCCGA
GCCGTGGGCACCATTCTGGGAGTGGCGACCACCGATTTGCCGTCGAATGCGCACTTCACC
GACTTAGGAGGAGACTCGTTGTCCGCGCTGACATTCGGTAGCCTGCTACGCGAACTCTTC
GACATCGATGTGCCGGTGGGCGTCATTGTCAGCCCTGTCAACAACTTGGTGGCGATCGCC
GACTACATCGAGCGCGAGCGGCAGGGCACGAAGCGGCCCACTTTCATTGCCATACACGGT
CGTGACGCTGGCAAAGTGCATGCCAGTGACCTCACTCTAGACAAATTCATCGATGTATCA
ACGCTGACTGCCGCGCCCGTATTGGCGCAACCCGGCACCGAGGTGCGCACCGTCCTGTTG
ACCGGCGCTACCGGCTTCCTGGGGCGCTACTTGGCCCTGAAATGGCTCGAACGGATGGAC
CTGGTCGAAGGGAAGGTAATCGCTCTGGTAAGAGCCAAGTCCAACGAGGACGCTCGGGCC
CGGCTCGACAAGACCTTCGATAGCGGAGACCCCAAACTGCTGGCGCACTACCAGGAACTG
GCAACCGACCACCTGGAGGTCATCGCCGGCGACAAAGGCGAAGTAGATCTGGAATTGGAC
CGGCAAACGTGGCGACGACTGGCCGACACGGTCGATCTGATCGTCGACCCCGCCGCCCTG
GTCAACCACGTGCTGCCGTACAGCGAGCTATTCGGCCCCAATACGTTAGGCACCGCCGAG
CTGATTCGGATCGCGCTGACCAGTAAGCAAAAGCCGTACATCTATGTGTCGACAATCGGC
GTCGGTAATCAGATTGAGCCAGCAAAATTCACCGAAGACTCCGACATCCGAGTCATTAGC
CCGACGCGCAACATCAACAACAACTATGCCAACGGCTACGGCAACAGCAAGTGGGCCGGC
GAAGTGCTGCTGCGCGAAGCTCACGACCTATGCGGTCTGCCGGTCACGGTCTTCCGCTGC
GACATGATCTTGGCCGACACCAGCTATGCCGGTCAGCTCAACGTCCCCGACATGTTTACT
CGAATGATGCTGAGTCTAGCCGCCACCGGCATCGCACCCGGCTCGTTCTACGAGCTAGAC
GCCGAGAGCAATCGGCAACGCGCCCACTACGACGGTCTGCCCGTCGAGTTCATCGCCGAA
GCGATCTCCACCCTGGGAGACCAAAGCCTGCACGATCGAGACGGGTTCACGACCTATCAT
GTAATGAACCCGCACGACGACGGCATCGGTATGGACGAGTTTGTGGACTGGTTAATTGAT
GCCGGCTGCCCTATACAACGCATCAACGACTACGACGAATGGCTGCGACGGTTTGAGATT
TCGCTGCGCGCCCTGCCCGAAAGGCAGCGTCACAGCTCACTGTTGCCGTTGTTGCACAAC
TACCAGAAGCCGGAGAAGCCATTGCACGGGTCGCTGGCACCCACAATCCGGTTCCGTACG
GCCGTTCAAAACGCGAACATTGGTCAGGACAAAGATATTCCGCATATCTCGCCGGCAATC
ATCGCCAAATATGTCAGCGATCTGCAGCTGCTCGGGCTGGTTTGA
```

Amino acid sequence (SEQ ID NO:74)

>uniprot|O69484|O69484_MYCLE Putative Acyl-CoA synthetase

```
MSTITKQEKQLARRVDDLTANDPQFAAAKPDPAVAAALAQPGLRLPQIIQ
TALDGYAERPALGQRVAEFTKDPKTGRTSMELLPSFETITYRQLGDRVGA
LARAWRHDLLHAGYRVCVLGFNSVDYAIIDMALGVIGAVAVPLQTSAAIT
QLQSIVTETEPSMIATSVNQLPDTVELILSGQAPAKLVVFDYHPEVDEQH
DAVATARARLADSSVVVESLTEVLGRGKTLPATPIPVADDSADPLALLIY
TSGSTGAPKGAMYLQSNVGKMWRRSDGNWFGPTAASITLNFMPMSHVMGR
GILYGTLGNGGTAYFAARSDLSTLLEDLKLVRPTELNFVPRIWETLYDES
KRAVDRRLANSGSADRAAIKAEVMDEQRQSLLGGRYIAAMTGSAPTSPEL
KHGVESLLEMHLLEGYGSTEAGMVLFDGEVQRPPVIDYKLVDVPDLGYFS
TDQPYPRGELLLKTQNMFPGYYKRPEVTATVFDSDGYYQTGDIVAEVGPD
RLVYVDRRNNVLKLAQGQFVTVAKLEAAFSNSPLVRQIYIYGNSAHPYLL
AVVVPTEDALATNDIEVLKPLIIDSLQKVAKEADLQSYEVPRDLIVETTP
FSLENGLLTGIRKLAWPKLKQHYGARLEQLYADLVEGQANALHVLKQSVA
NAPVLQTVSRAVGTILGVATTDLPSNAHFTDLGGDSLSALTFGSLLRELF
DIDVPVGVIVSPVNNLVAIADYIERERQGTKRPTFIAIHGRDAGKVHASD
LTLDKFIDVSTLTAAPVLAQPGTEVRTVLLTGATGFLGRYLALKWLERMD
LVEGKVIALVRAKSNEDARARLDKTFDSGDPKLLAHYQELATDHLEVIAG
DKGEVDLELDRQTWRRLADTVDLIVDPAALVNHVLPYSELFGPNTLGTAE
LIRIALTSKQKPYIYVSTIGVGNQIEPAKFTEDSDIRVISPTRNINNNYA
```

FIG. 8XX

NGYGNSKWAGEVLLREAHDLCGI,PVTVFRCDMILADTSYAGQLNVPDMFT
RMMLSLAATGIAPGSFYELDAESNRQRAHYDGLPVEFIAEAISTLGDQSL
HDRDGFTTYHVMNPHDDGIGMDEFVDWLIDAGCPIQRINDYDEWLRRFEI
SLRALPERQRHSSLLPLLHNYQKPEKPLHGSLAPTIRFRTAVQNANIGQD
KDIPHISPAIIAKYVSDLQLLGLV

Q10896

Nucleotide sequence (SEQ ID NO:75)

>uniprot|Q10896|Q10896_MYCTU PROBABLE PEPTIDE SYNTHETASE NRP (PEPTIDE SYNTHASE)

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACG
CTTTCCAACGGCGGTACCGCCTACTTCGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTG
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTCACGCTGGACAAGTTCATCGACGCTGCCACCCTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC

FIG. 8YY

```
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCGCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA
```

Amino acid sequence (SEQ ID NO:76)

```
>uniprot|Q10896|Q10896_MYCTU PROBABLE PEPTIDE SYNTHETASE NRP (PEPTIDE
SYNTHASE)

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL
```

FIG. 8ZZ

Q5YY80
Nucleotide sequence (SEQ ID NO:77)

>uniprot|Q5YY80|Q5YY80_NOCFA Putative carboxylic acid reductase

GTGGAATCCACACGAGCGACGCGTCTGCGGCAGCGGATCGCCGCCCTGTACGCCGACGAC
GCGCAGGTGCGCGACGCGCGGCCGGACGAGGCGATCAGCACGGCGCTGCGGGAACCGGGC
CTGCGGCTGCGCGAGCTCGTCGCCACCGTGGTCGACGGCTACCGCGACCGGCCCGCGCTG
GCCGCGCGCTCGGTGCAGCCGGCCGTCGACGCCGCGACCGGTGCCTGCGTGGCACGGTTG
CTGCCCGAGTACACGACGATGAGTTACGGCGAGCTCGGCCTGCGGTTGCGCGCGGTGGCC
GCGGCCTGGCAGCACGACGACGAAACCCGCCTTCGCCCCGGCGAATTCGTCGCGACCCTG
GGTTTCACCAGCCCCGACTACGCCGTCGTCGACCTGGCCTGCGTGTGGGCGGGCGCGGTG
GCGGTGCCGCTGCAGGCGAGCGCGTCGGTGACGCAGCTGACCGCCATCCTGGCCGAGACC
GCGCCCGCAATCCTGGCCACCGGCCTGGACACGCTGCCGCACGCGGTGGACTGTGTGCTC
GCCGGGGCCACGCCACGGGCACTGCACGTGTTCGACTTCGACCCCGCCATCGACGCGCAG
CGCACGGTGTACGAGGCGGCGTGTGCGCGGCTGGCCGGTACCGGTGTGCGCGTGCGCACG
CTCGCCGAGGTCGAGGACCGCGGCCGGGCGCTGCCGCCTGCCGTGATCGACGACGGCCCC
GGCGACGACCGGCTCGCCCTGTTGATCTACACCTCCGGCAGTACCGGCACGCCCAAGGGG
GCGATGTACACCGAGCGGCTGGTCGCGCTGATGTGGCTGGGCCAGCCGCAGGTCGCCGCG
CTCACCGTCAACTACCTGCCGCTCAGCCACGTCGCCGGGCGGCTGGCGCTGTTCGGGCTG
CTCGCGCGCGGCGGCACCGCCTACTTCACCGCGCGCGCCGACATGTCCACGCTGTTCGAG
GATCTGGCGCTGGCCAGGCCGACCGAGCTGTTCGTGGTGCCGCGCGTGTGCGAGATGGTG
CTGCAACGATTCCAGACCGAGCGGCTGCGGCGCCAGGCCGACGACGACCGGGTCAAGGCC
GACCTGCGCCTCGAACTGTTCGGCGACCGGCTGCTCTCGGTGGTGTGCGGCAGCGCGCCG
CTGGCCCCGGAGCTGAAGGCGTTCATGGAATCGGTGCTCGACCTGACCCTGCACGACGGC
TACGGCTCCACCGAGGCGGGCGGCAGCGTGGTCATCGACACCACCGTGCGCAGGCCGCCG
GTGCTGGACTACCGGCTCGCCGACGTGCCCGAACTGGGCTATTTCGTACCGACAAGCCG
CATCCGCGCGGCGAGCTGCTGCTCAAGACCACCACCATGATCCCCGGCTACTACCGGCGG
CCGGAGCTCAACGCCCAGATCTTCGACGAGGACGGCTTCTACCGCACCGGCGACGTGGTC
GCGGAACTGGCGCCGGACCGGCTCGTGTACGTCGATCGCCGCAACAATGTGCTCAAGCTG
GCGCAGGGCGAGTTCGTCACCATCGCCCGGCTGGAGGCGATCTTCGCCAACAGTCCGCTG
GTGCGCCAGATCTTCGTCTACGGCAACAGCGAACGCGCCTATCTGCTGGCGGTGATCGTG
CCGAGCCGACAGGCGATGGCGGGCGATCCGGCCACGCTGAAGACGCGGATCGCGGAGTCG
TTGCAGCTCATCGGCCGGGACGCCCGAGCTGGAGGCCTACGAGATCCCGCGCGACTTCCTG
ATCGAGACCGAGCCGTTCACCACCGAATCCGGGCTGCTCTCGGGCATCGGCAAGATCCTG
CGTCCCGCCGTCGAGGCGCGCTATCGCGACCGGCTCGAACAGCTCTACGCCGACCTGGCC
GCGGCCCAGCAGGACGAGCTGGCGGCGCTGCGCCGCGAGGCCGGGCAGCGTCCGGTGCTC
GAGACCGTCACCCGCGCGGCCGCCGCGATCCTCGGCGGCACGGCGAGCGACCTGAGCCCG
GCCGCGCACTTCACCGATCTCGGCGGCGATTCGCTGGCGGCGCTGGCGCTGTCGAACCTG
CTGCGTGAGATCTTCGCCGTCGAGGTGCCGGTCGGCGTCATCACCGGCCCCGCGACCGAC
CTCCGTGGCCTGGCCGCCCACATCGCCGCGGAACGCGAAAACCGCACCGAGACACCGCTG
TTCGACCGGGTGCATCCCGACCAGATCCTGATCCGGGCCACCGACCTCGCCCTGGAGAAG
TTCTTCGACGCCGAGGAGTTGGCCGCCGCGGCCACCGCCGCGCCGCCGGTCGCCGAGCCC
CGGGTGGTGCTGCTGACCGGTGCCAACGGCTATCTCGGCCGGTTTCTGTGCCTGGAATGG
CTGGAACGGCTCGACCGCGTCGACGGACGGCTGATCTGCCTGGTGCGCGGCGCGGACGAG
GCCGCCGCGCTGGCCCGCCTGGAAGCCGCCTTCGACAGCGGCGATCCCGAATTGGTGCGC
CGCTTCAAGGAATTGGCCCAGCGCAGGCTCACCGTGGTGGCCGGCGACATCGGCGAGCCC
GGCCTGGGCCTGGCCACCGCCACGTGGCGACGGCTCGCCGCCGAGGTCGAGCACATCGTG
CACCCGGCCGCGCTGGTCAACCACGTGCTGCCCTACCGGCAGCTGTTCGGGCCCAACGTG
GCGGGCACCGCGGAGATCCTGCGGCTCGCGCTCACCGAGCGGCGCAAGCCGATCGACTTC
CTGTCCACGGTCGCCGTTGCCGCGCAGATACCCGCCGACCGGTTCGCCGAGGACGGCGAC
ATCCGCGTGATCAGCCCGACCCGCACGGTGGACCGCGGCTACGCCAACGGCTACGGCAAC
AGCAAATGGGCCGCCGAGGTGTTGCTGCGTGCGGCGCACGACCGCTTCGATCTCCCGGTG

FIG. 8AAA

```
GCGGTGTTCCGCTCGGACATGATCCTGGCCCACGGCAGCTTCGCCGGACAGCTCAACATC
CCCGACGTGTTCACCCGGCTGCTGCTCAGCCTGCTGGTCACCGGTATCGCGCCCGCCTCG
TTCCACGCCGCGACGGTCACCGGCGAGCGCCCGCGCGCCCACTACGACGGGCTGCCCGCG
GACTTCACCGCTGCCGCGATCACCGCGCTCGGGGCGCGCACCGCGGGATTCCACACCTAC
GACGTGCTCAACCCGCACGACGACGGCATCAGCCTGGACACCTTCGTGGACTGGCTGATC
GAGGCCGGACATCCCATCGAACGCATCCCCGAGCACAGCGAGTGGGTCACCCGTTTCGAG
ACGGCGTTGCACGCCCTGCCCGAACGTCAGCGCAAACACTCGCTGCTCCCGCTGTTGCAC
GCCTACCGCAGGCCGGTGCCCGCGCTGCGCGGCTCGGCGCTGCCCGCCGCGGAGTTCCGG
GCGGCGGTGCGGCCGCAGGCATCACCGCCGACGGTGACATCCCGCACCTGACGCGCGCG
CTGATCGAGAAGTACGTCGCCGATCTCCGCCTGCACGGACTGTTGTAG
```

Amino acid sequence (SEQ ID NO:78)

>uniprot|Q5YY80|Q5YY80_NOCFA Putative carboxylic acid reductase

```
VESTRATRLRQRIAALYADDAQVRDARPDEAISTALREPGLRLRELVATV
VDGYRDRPALAARSVQPAVDAATGACVARLLPEYTTMSYGELGLRLRAVA
AAWQHDDETRLRPGEFVATLGFTSPDYAVVDLACVWAGAVAVPLQASASV
TQLTAILAETAPAILATGLDTLPHAVDCVLAGATPRALHVFDFDPAIDAQ
RTVYEAACARLAGTGVRVRTLAEVEDRGRALPPAVIDDGPGDDRLALLIY
TSGSTGTPKGAMYTERLVALMWLGQPQVAALTVNYLPLSHVAGRLALFGL
LARGGTAYFTARADMSTLFEDLALARPTELFVVPRVCEMVLQRFQTERLR
RQADDDRVKADLRLELFGDRLLSVVCGSAPLAPELKAFMESVLDLTLHDG
YGSTEAGGSVVIDTTVRRPPVLDYRLADVPELGYFRTDKPHPRGELLLKT
TTMIPGYYRRPELNAQIFDEDGFYRTGDVVAELAPDRLVYVDRRNNVLKL
AQGEFVTIARLEAIFANSPLVRQIFVYGNSERAYLLAVIVPSRQAMAGDP
ATLKTRIAESLQLIGRDAELEAYEIPRDFLIETEPFTTESGLLSGIGKIL
RPAVEARYRDRLEQLYADLAAAQQDELAALRREAGQRPVLETVTRAAAAI
LGGTASDLSPAAHFTDLGGDSLAALALSNLLREIFAVEVPVGVITGPATD
LRGLAAHIAAERENRTETPLFDRVHPDQILIRATDLALEKFFDAEELAAA
ATAAPPVAEPRVVLLTGANGYLGRFLCLEWLERLDRVDGRLICLVRGADE
AAALARLEAAFDSGDPELVRRFKELAQRRLTVVAGDIGEPGLGLATATWR
RLAAEVEHIVHPAALVNHVLPYRQLFGPNVAGTAEILRLALTERRKPIDF
LSTVAVAAQIPADRFAEDGDIRVISPTRTVDRGYANGYGNSKWAAEVLLR
AAHDRFDLPVAVFRSDMILAHGSFAGQLNIPDVFTRLLLSLLVTGIAPAS
FHAATVTGERPRAHYDGLPADFTAAAITALGARTAGFHTYDVLNPHDDGI
SLDTFVDWLIEAGHPIERIPEHSEWVTRFETALHALPERQRKHSLLPLLH
AYRRPVPALRGSALPAAEFRAAVRAAGITADGDIPHLTRALIEKYVADLR
LHGLL
```

Q6RKB1

Nucleotide sequence (SEQ ID NO:79)

>uniprot|Q6RKB1|Q6RKB1_9NOCA ATP/NADPH-dependent carboxylic acid reductase

```
ATGGCAGTGGATTCACCGGATGAGCGGCTACAGCGCCGCATTGCACAGTTGTTTGCAGAA
GATGAGCAGGTCAAGGCCGCACGTCCGCTCGAAGCGGTGAGCGCGGCGGTGAGCGCGCCC
GGTATGCGGCTGGCGCAGATCGCCGCCACTGTTATGGCGGGTTACGCCGACCGCCCGGCC
GCCGGGCAGCGTGCGTTCGAACTGAACACCGACGACGCGACGGGCCGCACCTCGCTGCGG
```

FIG. 8BBB

```
TTACTTCCCCGATTCGAGACCATCACCTATCGCGAACTGTGGCAGCGAGTCGGCGAGGTT
GCCGCGGCCTGGCATCATGATCCCGAGAACCCCTTGCGCGCAGGTGATTTCGTCGCCCTG
CTCGGCTTCACCAGCATCGACTACGCCACCCTCGACCTGGCCGATATCCACCTCGGCGCG
GTTACCGTGCCGTTGCAGGCCAGCGCGGCGGTGTCCCAGCTGATCGCTATCCTCACCGAG
ACTTCGCCGCGGCTGCTCGCCTCGACCCCGGAGCACCTCGATGCGGCGGTCGAGTGCCTA
CTCGCGGGCACCACACCGGAACGACTGGTGGTCTTCGACTACCACCCCGAGGACGACGAC
CAGCGTGCGGCCTTCGAATCCGCCCGCCGCCGCCTTGCCGACGCGGGCAGCTTGGTGATC
GTCGAAACGCTCGATGCCGTGCGTGCCCGGGGCCGCGACTTACCGGCCGCGCCACTGTTC
GTTCCCGACACCGACGACGACCCGCTGGCCCTGCTGATCTACACCTCCGGCAGCACCGGA
ACGCCGAAGGGCGCGATGTACACCAATCGGTTGGCCGCCACGATGTGGCAGGGGAACTCG
ATGCTGCAGGGGAACTCGCAACGGGTCGGGATCAATCTCAACTACATGCCGATGAGCCAC
ATCGCCGGTCGCATATCGCTGTTCGGCGTGCTCGCTCGCGGTGGCACCGCATACTTCGCG
GCCAAGAGCGACATGTCGACACTGTTCGAAGACATCGGCTTGGTACGTCCCACCGAGATC
TTCTTCGTCCCGCGCGTGTGCGACATGGTCTTCCAGCGCTATCAGAGCGAGCTGGACCGG
CGCTCGGTGGCGGGCGCCGACCTGGACACGCTCGATCGGGAAGTGAAAGCCGACCTCCGG
CAGAACTACCTCGGTGGGCGCTTCCTGGTGGCGGTCGTCGGCAGCGCGCCGCTGGCCGCG
GAGATGAAGACGTTCATGGAGTCCGTCCTCGATCTGCCACTGCACGACGGGTACGGGTCG
ACCGAGGCGGGCGCAAGCGTGCTGCTCGACAACCAGATCCAGCGGCCGCCGGTGCTCGAT
TACAAGCTCGTCGACGTGCCCGAACTGGGTTACTTCCGCACCGACCGGCCGCATCCGCGC
GGTGAGCTGTTGTTGAAGGCGGAGACCACGATTCCGGGCTACTACAAGCGGCCCGAGGTC
ACCGCGGAGATCTTCGACGAGGACGGCTTCTACAAGACCGGCGATATCGTGGCCGAGCTC
GAGCACGATCGGCTGGTCTATGTCGACCGTCGCAACAATGTGCTCAAACTGTCGCAGGGC
GAGTTCGTGACCGTCGCCCATCTCGAGGCCGTGTTCGCCAGCAGCCCGCTGATCCGGCAG
ATCTTCATCTACGGCAGCAGCGAACGTTCCTATCTGCTCGCGGTGATCGTCCCCACCGAC
GACGCGCTGCGCGGCCGCGACACCGCCACCTTGAAATCGGCACTGGCCGAATCGATTCAG
CGCATCGCCAAGGACGCGAACCTGCAGCCCTACGAGATTCCGCGCGATTTCCTGATCGAG
ACCGAGCCGTTCACCATCGCCAACGGACTGCTCTCCGGCATCGCGAAGCTGCTGCGCCCC
AATCTGAAGGAACGCTACGGCGCTCAGCTGGAGCAGATGTACACCGATCTCGCGACAGGC
CAGGCCGATGAGCTGCTCGCCCTGCGCCGCAAGCCGCCGACCTGCCGGTGCTCGAAACC
GTCAGCCGGGCAGCGAAAGCGATGCTCGGCGTCGCCTCCGCCGATATGCGTCCCGACGCG
CACTTCACCGACCTGGGCGGCGATTCCCTTTCCGCGCTGTCGTTCTCGAACCTGCTGCAC
GAGATCTTCGGGGTCGAGGTGCCGGTGGGTGTCGTCGTCAGCCCGGCGAACGAGCTGCGC
GATCTGGCGAATTACATTGAGGCGGAACGCAACTCGGGCGCGAAGCGTCCCACCTTCACC
TCGGTGCACGGCGGCGGTTCCGAGATCCGCGCCGCCGATCTGACCCTCGACAAGTTCATC
GATGCCCGCACCCTGGCCGCCGCCGACAGCATTCCGCACGCGCCGGTGCCAGCGCAGACG
GTGCTGCTGACCGGCGCGAACGGCTACCTCGGCCGGTTCCTGTGCCTGGAATGGCTGGAG
CGGCTGGACAAGACGGGTGGCACGCTGATCTGCGTCGTGCGCGGTAGTGACGCGGCCGCG
GCCCGTAAACGGCTGGACTCGGCGTTCGACAGCGGCGATCCCGGCCTGCTCGAGCACTAC
CAGCAACTGGCCGCACGGACCCTGGAAGTCCTCGCCGGTGATATCGGCGACCCGAATCTC
GGTCTGGACGACGCGACTTGGCAGCGGTTGGCCGAAACCGTCGACCTGATCGTCCATCCC
GCCGCGTTGGTCAACCACGTCCTTCCCTACACCCAGCTGTTCGGCCCCAATGTCGTCGGC
ACCGCCGAAATCGTCCGGTTGGCGATCACGGCGCGGCGCAAGCCGGTCACCTACCTGTCG
ACCGTCGGAGTGGCCGACCAGGTCGACCCGGCGGAGTATCAGGAGGACAGCGACGTCCGC
GAGATGAGCGCGGTGCGCGTCGTGCGCGAGAGTTACGCCAACGGCTACGGCAACAGCAAG
TGGGCGGGGAGGTCCTGCTGCGCGAAGCACACGATCTGTGTGGCTTGCCGGTCGCGGTG
TTCCGTTCGGACATGATCCTGGCGCACAGCCGGTACGCGGGTCAGCTCAACGTCCAGGAC
GTGTTCACCCGGCTGATCCTCAGCCTGGTCGCCACCGGCATCGCGCCGTACTCGTTCTAC
CGAACCGACGCGGACGGCAACCGGCAGCGGGCCCACTATGACGGCTTGCCGGCGGACTTC
ACGGCGGCGGCGATCACCGCGCTCGGCATCCAAGCCACCGAAGGCTTCCGGACCTACGAC
GTGCTCAATCCGTACGACGATGGCATCTCCCTCGATGAATTCGTCGACTGGCTCGTCGAA
TCCGGCCACCCGATCCAGCGCATCACCGACTACAGCGACTGGTTCCACCGTTTCGAGACG
GCGATCCGCGCGCTGCCGGAAAAGCAACGCCAGGCCTCGGTGCTGCCGTTGCTGGACGCC
TACCGCAACCCCTGCCCGGCGGTCCGCGGCGCGATACTCCCGGCCAAGGAGTTCCAAGCG
GCGGTGCAAACAGCCAAAATCGGTCCGGAACAGGACATCCCGCATTTGTCCGCGCCACTG
```

FIG. 8CCC

ATCGATAAGTACGTCAGCGATCTGGAACTGCTTCAGCTGCTCTGA

Amino acid sequence (SEQ ID NO:80)

>uniprot|Q6RKB1|Q6RKB1_9NOCA ATP/NADPH-dependent carboxylic acid reductase

MAVDSPDERLQRRIAQLFAEDEQVKAARPLEAVSAAVSAPGMRLAQIAAT
VMAGYADRPAAGQRAFELNTDDATGRTSLRLLPRFETITYRELWQRVGEV
AAAWHHDPENPLRAGDFVALLGFTSIDYATLDLADIHLGAVTVPLQASAA
VSQLIAILTETSPRLLASTPEHLDAAVECLLAGTTPERLVVFDYHPEDDD
QRAAFESARRRLADAGSLVIVETLDAVRARGRDLPAAPLFVPDTDDDPLA
LLIYTSGSTGTPKGAMYTNRLAATMWQGNSMLQGNSQRVGINLNYMPMSH
IAGRISLFGVLARGGTAYFAAKSDMSTLFEDIGLVRPTEIFFVPRVCDMV
FQRYQSELDRRSVAGADLDTLDREVKADLRQNYLGGRFLVAVVGSAPLAA
EMKTFMESVLDLPLHDGYGSTEAGASVLLDNQIQRPPVLDYKLVDVPELG
YFRTDRPHPRGELLLKAETTIPGYYKRPEVTAEIFDEDGFYKTGDIVAEL
EHDRLVYVDRRNNVLKLSQGEFVTVAHLEAVFASSPLIRQIFIYGSSERS
YLLAVIVPTDDALRGRDTATLKSALAESIQRIAKDANLQPYEIPRDFLIE
TEPFTIANGLLSGIAKLLRPNLKERYGAQLEQMYTDLATGQADELLALRR
EAADLPVLETVSRAAKAMLGVASADMRPDAHFTDLGGDSLSALSFSNLLH
EIFGVEVPVGVVVSPANELRDLANYIEAERNSGAKRPTFTSVHGGGSEIR
AADLTLDKFIDARTLAAADSIPHAPVPAQTVLLTGANGYLGRFLCLEWLE
RLDKTGGTLICVVRGSDAAAARKRLDSAFDSGDPGLLEHYQQLAARTLEV
LAGDIGDPNLGLDDATWQRLAETVDLIVHPAALVNHVLPYTQLFGPNVVG
TAEIVRLAITARRKPVTYLSTVGVADQVDPAEYQEDSDVREMSAVRVVRE
SYANGYGNSKWAGEVLLREAHDLCGLPVAVFRSDMILAHSRYAGQLNVQD
VFTRLILSLVATGIAPYSFYRTDADGNRQRAHYDGLPADFTAAAITALGI
QATEGFRTYDVLNPYDDGISLDEFVDWLVESGHPIQRITDYSDWFHRFET
AIRALPEKQRQASVLPLLDAYRNPCPAVRGAILPAKEFQAAVQTAKIGPE
QDIPHLSAPLIDKYVSDLELLQLL

Q741P9

Nucleotide sequence (SEQ ID NO:81)

>uniprot|Q741P9|Q741P9_MYCPA FadD9

ATGTCGACTGCCACCCATGACGAACGACTCGACCGTCGCGTCCACGAACTCATCGCCACC
GACCCGCAATTCGCCGCCGCCCAACCCGACCCGGCGATCACCGCCGCCCTCGAACAGCCC
GGGCTGCGGCTGCCGCAGATCATCCGCACCGTGCTCGACGGCTACGCCGACCGGCCGGCG
CTGGGACAGCGCGTGGTGGAGTTCGTCACGGACGCCAAGACCGGGCGCACGTCGGCGCAG
CTGCTCCCCCGCTTCGAGACCATCACGTACAGCGAAGTAGCGCAGCGTGTTTCGGCGCTG
GGCCGCGCCCTGTCCGACGACGCGGTGCACCCCGGCGACCGGGTGTGCGTGCTGGGCTTC
AACAGCGTCGACTACGCCACCATCGACATGGCGCTGGGCGCCATCGGCGCCGTCTCGGTG
CCGCTGCAGACCAGCGCGGCAATCAGCTCGCTGCAGCCGATCGTGGCCGAGACCGAGCCC
ACCCTGATCGCGTCCAGCGTGAACCAGCTGTCCGACGCGGTGCAGCTGATCACCGGCGCC
GAGCAGGCGCCCACCCGGCTGGTGGTGTTCGACTACACCCGCAGGTCGACGACCAGCGC
GAGGCCGTCCAGGACGCCGCGGCGCGGCTGTCCAGCACCGGCGTGGCCGTCCAGACGCTG
GCCGAGCTGCTGGAGCGCGGCAAGGACCTGCCCGCCGTCGCGGAGCCGCCCGCCGACGAG
GACTCGCTGGCCCTGCTGATCTACACCTCCGGGTCCACCGGCGCCCCCAAGGGCGCGATG
TACCCACAGAGCAACGTCGGCAAGATGTGGCGCCGCGGCAGCAAGAACTGGTTCGGCGAG
AGCGCCGCGTCGATCACCCTGAACTTCATGCCGATGAGCCACGTGATGGGCCGAAGCATC

FIG. 8DDD

```
CTCTACGGCACGCTGGGCAACGGCGGCACCGCCTACTTCGCCGCCCGCAGCGACCTGTCC
ACCCTGCTTGAGGACCTCGAGCTGGTGCGGCCCACCGAGCTCAACTTCGTCCCGCGGATC
TGGGAGACGCTGTACGGCGAATTCCAGCGTCAGGTCGAGCGGCGGCTCTCCGAGGCCGGG
GACGCCGGCGAACGTCGCGCCGTCGAGGCCGAGGTGCTGGCCGAGCAGCGCCAGTACCTG
CTGGGCGGGCGGTTCACCTTCGCGATGACGGGCTCGGCGCCCATCTCGCCGGAGCTGCGC
AACTGGGTCGAGTCGCTGCTCGAAATGCACCTGATGGACGGCTACGGCTCCACCGAGGCC
GGAATGGTGTTGTTCGACGGGGAGATTCAGCGCCCGCCGGTGATCGACTACAAGCTGGTC
GACGTGCCGGACCTGGGCTACTTCAGCACCGACCGGCCGCATCCGCGCGGCGAGCTGCTG
CTGCGCACCGAGAACATGTTCCCGGGCTACTACAAGCGGGCCGAAACCACCGCGGGCGTC
TTCGACGAGGACGGCTACTACCGCACCGGCGACGTGTTCGCCGAGATCGCCCCGGACCGG
CTGGTCTACGTCGACCGCCGCAACAACGTGCTCAAGCTGGCGCAGGGCGAATTCGTCACG
CTGGCCAAGCTGGAGGCGGTGTTCGGCAACAGCCCGCTGATCCGCCAGATCTACGTCTAC
GGCAACAGCGCCCAGCCCTACCTGCTGGCGGTCGTGGTGCCCACCGAGGAGGCGCTGGCC
TCGGGTGACCCCGAGACGCTCAAGCCCAAGATCGCCGACTCGCTGCAGCAGGTCGCCAAG
GAGGCCGGCCTGCAGTCCTACGAGGTGCCGCGCGACTTCATCATCGAGACCACCCGTTC
AGCCTGGAAAACGGTCTGCTGACCGGGATCCGGAAGCTGGCGTGGCCGAAACTGAAGCAG
CACTACGGGAACGGCTGGAGCAGATGTACGCCGACCTGGCCGCCGGACAGGCCAACGAG
CTGGCCGAGCTGCGCCGCAACGGTGCCCAGGCGCCGGTGTTGCAGACCGTGAGCCGCGCC
GCGGGCGCCATGCTGGGTTCGGCCGCCTCCGACCTGTCCCCGACGCCCACTTCACCGAT
CTGGGCGGAGACTCGTTGTCGGCGTTGACATTCGGCAACCTGCTGCGCGAGATCTTCGAC
GTCGACGTGCCGGTAGGCGTGATCGTCAGCCCGGCCAACGACCTGGCGGCCATCGCGAGC
TACATCGAGGCCGAGCGGCAGGGCAGCAAGCGCCCGACGTTCGCCTCGGTGCACGGCCGG
GACGCGACCGTGGTGCGCGCCGCCGACCTGACGCTGGACAAGTTCCTCGACGCCGAGACG
CTGGCCGCCGCGCCGAACCTGCCCAAGCCGGCCACCGAGGTGCGCACCGTGCTGCTGACC
GGCGCCACCGGCTTCCTGGGCCGCTACCTGGCCCTGGAATGGCTGGAGCGGATGGACATG
GTGGACGGCAAGGTCATCGCCCTGGTCCGGGCCCGCTCCGACGAGGAGGCACGCGCCCGG
CTGGACAAGACCTTCGACAGCGGCGACCCGAAACTGCTCGCGCACTACCAGCAGCTGGCC
GCCGATCACCTGGAGGTCATCGCCGGCGACAAGGGCGAGGCCAATCTGGGCCTGGGCCAA
GACGTTTGGCAACGACTGGCCGACACGGTCGACGTGATCGTCGACCCCGCCGCGCTGGTC
AACCACGTGTTGCCGTACAGCGAGCTGTTCGGCCCAACGCCCTGGGCACCGCGGAGCTG
ATCCGGCTGGCGCTGACGTCCAAGCAGAAGCCGTACACCTACGTGTCCACCATCGGCGTG
GGCGACCAGATCGAGCCGGGCAAGTTCGTCGAGAACGCCGACATCCGGCAGATGAGCGCC
ACCCGGGCGATCAACGACAGCTACGCCAACGGCTATGGCAACAGCAAGTGGGCCGGCGAG
GTGCTGCTGCGCGAGGCGCACGACCTGTGCGGGCTGCCCGTCGCGGTGTTCCGCTGCGAC
ATGATCCTGGCCGACACCACGTATGCCGGGCAGCTCAACCTGCCGGACATGTTCACCCGG
CTGATGCTGAGCCTGGTGGCCACCGGGATCGCGCCCGGCTCGTTCTACGAGCTCGACGCC
GACGGCAACCGGCAGCGGGCGCACTACGACGGCCTGCCGGTCGAGTTCATCGCCGCGGCG
ATCTCGACGCTGGGTTCGCAGATCACCGACAGCGACACCGGCTTCCAGACCTACCACGTG
ATGAACCCCTACGATGACGGCGTCGGTCTGGACGAGTACGTCGATTGGCTGGTGGACGCC
GGCTATTCGATCGAGCGGATCGCCGACTACTCCGAATGGCTGCGGCGGTTCGAGACCTCG
CTGCGGGCCCTGCCGGACCGGCAGCGCCAGTACTCGCTGCTGCCGCTGCTGCACAACTAC
CGCACGCCGGAGAAGCCGATCAACGGGTCGATAGCTCCCACCGACGTGTTCCGGGCAGCG
GTGCAGGAGGCGAAAATCGGCCCCGACAAAGACATTCCGCACGTGTCGCCGCCGGTCATC
GTCAAGTACATCACCGACCTGCAGCTGCTCGGGCTGCTCTGA
```

Amino acid sequence (SEQ ID NO:82)

>uniprot|Q741P9|Q741P9_MYCPA FadD9

MSTATHDERLDRRVHELIATDPQFAAAQPDPAITAALEQPGLRLPQIIRT
VLDGYADRPALGQRVVEFVTDAKTGRTSAQLLPRFETITYSEVAQRVSAL
GRALSDDAVHPGDRVCVLGFNSVDYATIDMALGAIGAVSVPLQTSAAISS
LQPIVAETEPTLIASSVNQLSDAVQLITGAEQAPTRLVVFDYHPQVDDQR
EAVQDAAARLSSTGVAVQTLAELLERGKDLPAVAEPPADEDSLALLIYTS

FIG. 8EEE

```
GSTGAPKGAMYPQSNVGKMWRRGSKNWFGESAASITLNFMPMSHVMGRSI
LYGTLGNGGTAYFAARSDLSTLLEDLELVRPTELNFVPRIWETLYGEFQR
QVERRLSEAGDAGERRAVEAEVLAEQRQYLLGGRFTFAMTGSAPISPELR
NWVESLLEMHLMDGYGSTEAGMVLFDGEIQRPPVIDYKLVDVPDLGYFST
DRPHPRGELLLRTENMFPGYYKRAETTAGVFDEDGYYRTGDVFAEIAPDR
LVYVDRRNNVLKLAQGEFVTLAKLEAVFGNSPLIRQIYVYGNSAQPYLLA
VVVPTEEALASGDPETLKPKIADSLQQVAKEAGLQSYEVPRDFIIETTPF
SLENGLLTGIRKLAWPKLKQHYGERLEQMYADLAAGQANELAELRRNGAQ
APVLQTVSRAAGAMLGSAASDLSPDAHFTDLGGDSLSALTFGNLLREIFD
VDVPVGVIVSPANDLAAIASYIEAERQGSKRPTFASVHGRDATVVRAADL
TLDKFLDAETLAAAPNLPKPATEVRTVLLTGATGFLGRYLALEWLERMDM
VDGKVIALVRARSDEEARARLDKTFDSGDPKLLAHYQQLAADHLEVIAGD
KGEANLGLGQDVWQRLADTVDVIVDPAALVNHVLPYSELFGPNALGTAEL
IRLALTSKQKPYTYVSTIGVGDQIEPGKFVENADIRQMSATRAINDSYAN
GYGNSKWAGEVLLREAHDLCGLPVAVFRCDMILADTTYAGQLNLPDMFTR
LMLSLVATGIAPGSFYELDADGNRQRAHYDGLPVEFIAAAISTLGSQITD
SDTGFQTYHVMNPYDDGVGLDEYVDWLVDAGYSIERIADYSEWLRRFETS
LRALPDRQRQYSLLPLLHNYRTPEKPINGSIAPTDVFRAAVQEAKIGPDK
DIPHVSPPVIVKYITDLQLLGLL
```

Q7D6X4

Nucleotide sequence (SEQ ID NO:83)

>uniprot|Q7D6X4|Q7D6X4_MYCTU Substrate--CoA ligase, putative

```
ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGCCGTCAGGTGCTCTACGGGACG
CTTTCCAACGGCGGTACCGCCTACTTCGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
```

FIG. 8FFF

```
TACCCGCTGGCGGTGGTTGTCCCGTCCGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTG
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTCACGCTGGACAAGTTCATCGACGCTGCCACCTTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCGCCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA
```

Amino acid sequence (SEQ ID NO:84)

>uniprot|Q7D6X4|Q7D6X4_MYCTU Substrate--CoA ligase, putative

```
MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
```

FIG. 8GGG

GLDRVTWQRLADTVDLIVDPAALVNHVLPYSQLFGPNAAGTAELLRLALT
GKRKPYIYTSTIAVGEQIRPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL

Q7TY99

Nucleotide sequence (SEQ ID NO:85)

>uniprot|Q7TY99|Q7TY99_MYCBO PROBABLE FATTY-ACID-CoA LIGASE FADD9
(FATTY-ACID-COA SYNTHETASE) (FATTY-ACID-COA SYNTHASE)

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACG
CTTTCCAACGGCGGTACCGCCTACTACGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTA
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTCACGCTGGACAAGTTCATCGACGCTGCCACCCTGGCCGCAGCCCCGAAC

FIG. 8HHH

```
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCCGCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACACCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA
```

Amino acid sequence (SEQ ID NO:.86)

>uniprot|Q7TY99|Q7TY99_MYCBO PROBABLE FATTY-ACID-CoA LIGASE FADD9 (FATTY-ACID-COA SYNTHETASE) (FATTY-ACID-COA SYNTHASE)

```
MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYYVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHTSLLPLLHNYREPAKPICGSIAPTDQFRAAVQEAKIGPDKDIPHL
TAAIIAKYISNLRLLGLL
```

FIG. 8III

Q9CCT4

Nucleotide sequence (SEQ ID NO:87)

>uniprot|Q9CCT4|Q9CCT4_MYCLE Putative acyl-CoA synthetase

```
GTGTGGCGCCAACAGTCTATTTCTCATCGCAAGGAATCTGTTATGTCGACTATCACTAAG
CAGGAAAAGCAGCTCGCACGCCGCGTTGACGACCTCACCGCCAACGACCCGCAGTTCGCC
GCCGCCAAACCCGACCCGGCGGTAGCCGCCGCCCTTGCCCAGCCCGGGCTTCGACTGCCC
CAAATCATCCAGACCGCGCTGGACGGTTACGCGGAGCGGCCGGCACTGGGCCAGCGCGTC
GCCGAGTTCACCAAAGACCCTAAGACCGGACGCACCTCGATGGAGCTGCTCCCCAGCTTT
GAGACCATCACCTACCGCCAGTTGGGCGACCGTGTCGGAGCGCTGGCGCGCGCCTGGAGG
CACGACCTACTGCACGCCGGCTACCGGGTCTGCGTGCTAGGTTTCAACAGTGTCGATTAC
GCCATCATCGACATGGCGCTCGGCGTGATTGGTGCTGTGGCGGTTCCACTGCAGACCAGT
GCGGCGATCACCCAGCTGCAGTCGATCGTGACCGAGACCGAACCCAGTATGATCGCGACG
AGCGTAAACCAGCTGCCCGATACTGTCGAGCTGATCCTGTCTGGCCAGGCGCCAGCGAAG
CTCGTTGTGTTTGACTACCACCCCGAGGTCGACGAGCAGCATGACGCAGTGGCAACCGCC
CGGGCGCGGTTGGCGGACAGTAGCGTGGTGGTCGAGAGCCTGACCGAGGTCCTCGGTCGC
GGCAAGACGCTGCCAGCTACGCCGATCCCCGTGGCCGATGACTCTGCTGACCCGTTGGCG
TTGCTGATCTACACATCTGGCAGCACCGGCGCACCCAAGGGCGCGATGTATCTGCAAAGC
AATGTCGGCAAGATGTGGCGCCGGTCAGACGGAAACTGGTTCGGGCCAACCGCCGCGTCA
ATCACTCTTAACTTCATGCCGATGAGCCACGTCATGGGCCGCGGAATCCTCTACGGCACG
CTCGGTAACGGCGGCACGGCTTACTTCGCCGCCCGCAGCGACCTCTCGACGCTGCTGGAG
GATCTCAAGCTGGTGCGGCCGACCGAGTTGAACTTTGTACCGCGCATCTGGGAAACCCTC
TACGATGAATCCAAACGCGCAGTTGACCGTCGGTTAGCCAACAGCGGCTCCGCCGACCGT
GCAGCCATCAAAGCCGAAGTTATGGATGAACAGCGGCAATCCCTGCTGGGAGGACGGTAC
ATCGCGGCTATGACGGGCTCGGCGCCAACCTCCCCGGAGTTGAAACACGGGTCGAGTCC
CTACTCGAAATGCATCTGTTGGAAGGCTACGGCTCCACCGAAGCCGGCATGGTCTTGTTT
GACGGCGAAGTGCAACGTCCGCCGGTTATCGATTACAAGCTGGTCGACGTTCCGGATTTG
GGCTACTTCAGCACCGACCAGCCTTATCCGAGAGGTGAATTGCTGCTCAAGACCCAGAAC
ATGTTCCCCGGCTACTACAAGCGTCCTGAGGTTACCGCCACCGTGTTCGACAGCGACGGT
TACTACCAGACCGGAGACATTGTCGCCGAAGTCGGTCCCGACCGGCTCGTGTACGTCGAT
CGCCGCAACAACGTGCTGAAACTCGCGCAGGGCCAGTTCGTCACCGTCGCGAAACTCGAG
GCAGCGTTCAGCAATAGCCCACTGGTCCGGCAGATCTACATCTATGGCAACAGCGCACAC
CCCTACCTGTTGGCTGTTGTGGTGCCGACCGAGGATGCGTTGGCTACCAATGACATTGAG
GTGCTCAAACCGCTGATTATCGATTCTTTACAGAAAGTAGCGAAAGAAGCCGACCTGCAG
TCCTACGAGGTGCCGCGCGACTTAATCGTCGAGACTACACCGTTCAGCCTGGAGAATGGC
CTGCTCACCGGTATTCGCAAGCTGGCGTGGCCGAAGCTCAAGCAGCACTACGGCGCGCGA
CTCGAACAGCTCTACGCCGATCTGGTTGAAGGTCAGGCAAATGCACTGCACGTGCTAAAA
CAAAGCGTGGCGAACGCTCCGGTACTGCAGACGGTGAGCCGAGCCGTGGGCACCATTCTG
GGAGTGGCGACCACCGATTTGCCGTCGAATGCGCACTTCACCGACTTAGGAGGAGACTCG
TTGTCCGCGCTGACATTCGGTAGCCTGCTACGCGAACTCTTCGACATCGATGTGCCGGTG
GGCGTCATTGTCAGCCCTGTCAACAACTTGGTGGCGATCGCCGACTACATCGAGCGCGAG
CGGCAGGGCACGAAGCGGCCCACTTTCATTGCCATACACGGTCGTGACGCTGGCAAAGTG
CATGCCAGTGACCTCACTCTAGACAAATTCATCGATGTATCAACGCTGACTGCCGCGCCC
GTATTGGCGCAACCCGGCACCGAGGTGCGCACCGTCCTGTTGACCGGCGCTACCGGCTTC
CTGGGGCGCTACTTGGCCCTGAAATGGCTCGAACGGATGGACCTGGTCGAAGGGAAGGTA
ATCGCTCTGGTAAGAGCCAAGTCCAACGAGGACGCTCGGGCCCGGCTCGACAAGACCTTC
GATAGCGGAGACCCCAAACTGCTGGCGCACTACCAGGAACTGGCAACCGACCACCTGGAG
GTCATCGCCGGCGACAAAGGCGAAGTAGATCTGGAATTGGACCGGCAAACGTGGCGACGA
CTGGCCGACACGGTCGATCTGATCGTCGACCCCGCCGCCCTGGTCAACCACGTGCTGCCG
TACAGCGAGCTATTCGGCCCCAATACGTTAGGCACCGCCGAGCTGATTCGGATCGCGCTG
ACCAGTAAGCAAAAGCCGTACATCTATGTGTCGACAATCGGCGTCGGTAATCAGATTGAG
```

FIG. 8JJJ

```
CCAGCAAAATTCACCGAAGACTCCGACATCCGAGTCATTAGCCCGACGCGCAACATCAAC
AACAACTATGCCAACGGCTACGGCAACAGCAAGTGGGCCGGCGAAGTGCTGCTGCGCGAA
GCTCACGACCTATGCGGTCTGCCGGTCACGGTCTTCCGCTGCGACATGATCTTGGCCGAC
ACCAGCTATGCCGGTCAGCTCAACGTCCCCGACATGTTTACTCGAATGATGCTGAGTCTA
GCCGCCACCGGCATCGCACCCGGCTCGTTCTACGAGCTAGACGCCGAGAGCAATCGGCAA
CGCGCCCACTACGACGGTCTGCCCGTCGAGTTCATCGCCGAAGCGATCTCCACCCTGGGA
GACCAAAGCCTGCACGATCGAGACGGGTTCACGACCTATCATGTAATGAACCCGCACGAC
GACGGCATCGGTATGGACGAGTTTGTGGACTGGTTAATTGATGCCGGCTGCCCTATACAA
CGCATCAACGACTACGACGAATGGCTGCGACGGTTTGAGATTTCGCTGCGCGCCCTGCCC
GAAAGGCAGCGTCACAGCTCACTGTTGCCGTTGTTGCACAACTACCAGAAGCCGGAGAAG
CCATTGCACGGGTCGCTGGCACCCACAATCCGGTTCCGTACGGCCGTTCAAAACGCGAAC
ATTGGTCAGGACAAAGATATTCCGCATATCTCGCCGGCAATCATCGCCAAATATGTCAGC
GATCTGCAGCTGCTCGGGCTGGTTTGA
```

Amino acid sequence (SEQ ID NO:88)

>uniprot|Q9CCT4|Q9CCT4_MYCLE Putative acyl-CoA synthetase

```
VWRQQSISHRKESVMSTITKQEKQLARRVDDLTANDPQFAAAKPDPAVAA
ALAQPGLRLPQIIQTALDGYAERPALGQRVAEFTKDPKTGRTSMELLPSF
ETITYRQLGDRVGALARAWRHDLLHAGYRVCVLGFNSVDYAIIDMALGVI
GAVAVPLQTSAAITQLQSIVTETEPSMIATSVNQLPDTVELILSGQAPAK
LVVFDYHPEVDEQHDAVATARARLADSSVVVESLTEVLGRGKTLPATPIP
VADDSADPLALLIYTSGSTGAPKGAMYLQSNVGKMWRRSDGNWFGPTAAS
ITLNFMPMSHVMGRGILYGTLGNGGTAYFAARSDLSTLLEDLKLVRPTEL
NFVPRIWETLYDESKRAVDRRLANSGSADRAAIKAEVMDEQRQSLLGGRY
IAAMTGSAPTSPELKHGVESLLEMHLLEGYGSTEAGMVLFDGEVQRPPVI
DYKLVDVPDLGYFSTDQPYPRGELLLKTQNMFPGYYKRPEVTATVFDSDG
YYQTGDIVAEVGPDRLVYVDRRNNVLKLAQGQFVTVAKLEAAFSNSPLVR
QIYIYGNSAHPYLLAVVVPTEDALATNDIEVLKPLIIDSLQKVAKEADLQ
SYEVPRDLIVETTPFSLENGLLTGIRKLAWPKLKQHYGARLEQLYADLVE
GQANALHVLKQSVANAPVLQTVSRAVGTILGVATTDLPSNAHFTDLGGDS
LSALTFGSLLRELFDIDVPVGVIVSPVNNLVAIADYIERERQGTKRPTFI
AIHGRDAGKVHASDLTLDKFIDVSTLTAAPVLAQPGTEVRTVLLTGATGF
LGRYLALKWLERMDLVEGKVIALVRAKSNEDARARLDKTFDSGDPKLLAH
YQELATDHLEVIAGDKGEVDLELDRQTWRRLADTVDLIVDPAALVNHVLP
YSELFGPNTLGTAELIRIALTSKQKPYIYVSTIGVGNQIEPAKFTEDSDI
RVISPTRNINNNYANGYGNSKWAGEVLLREAHDLCGLPVTVFRCDMILAD
TSYAGQLNVPDMFTRMMLSLAATGIAPGSFYELDAESNRQRAHYDGLPVE
FIAEAISTLGDQSLHDRDGFTTYHVMNPHDDGIGMDEFVDWLIDAGCPIQ
RINDYDEWLRRFEISLRALPERQRHSSLLPLLHNYQKPEKPLHGSLAPTI
RFRTAVQNANIGQDKDIPHISPAIIAKYVSDLQLLGLV
```

Q54JK0

Nucleotide sequence (SEQ ID NO:89)

>uniprot|Q54JK0|Q54JK0_DICDI Putative uncharacterized protein

```
ATGTTAAAACATATTAAAATTTTTTAACTAGAAAAGAAGAAAGAAAAGAAAAAGAAGTA
GAGAAATTAAAAGATGGAGTATCAATAACTGAGGTTAAACAATCGAACCTAGTAGTTTAT
TCATGCAATGGTTGTGGATCAGAGATATGGCCACCAAAACAAGAGAGATATGCATGTAAT
GAATGCTCAAATTTCGATTTATGTAGTGAGTGTTATAGAAAAGAAATGATATTAATAAAT
```

FIG. 8KKK

```
GGTACACAAGAAGAGAAAGATAAATTAGTTAGTGGGGAGAGTAATAATGGAATAAAGTAC
GAGCCAGTGAGACATTATGATCCATCACCATTACCTCATCAATTAACATTAGAGAATGAG
ACTCAATTTCAATTAGTTTATAGTTTACGTGGTAATTCAACATTTGAAACAATGGAGAAA
TCATTTAAATACTTTAAAAACAGACCATGTCTTGGTATTAGAGAGAGATTAGGAGAGGAT
AATGTTTTATCAGAAAGATATAAATGGTTAACATATGGTGAAGTGTATGAGAAATCTTTA
ACCTTGGCAAAGGCATTAACTAATTTCATCGAAAGAAGAGATTTCATTTCAATCTATATG
GATAATTGCTTAGAATGGTATTTCACAGATTTTGCATCATTATGGGCCGGATTAATAGTG
GTACCATTACATCATGCTTCAAATAGTTTTAATCTTTTAGAGATTCTTTGGAATTCCGAA
TCAAAATGTATAGTTTGTTCTGGTGAATCATTTAAAAATTTAATAGAACTTTATGATCAA
TTGACTGAGCAAGATAAATTAGAGAAACCAATAGTGTTGAAATTGATAGTTCATAAGGAG
GATCTATTCGATCAGTCATTAGTCGATAGATTGCCAAGTGGCGTAGAATTTAAAACTTTC
AATGAGATGATTAAAATTGGGGAATCATTAAGTCAGGCTAAATATGAATTTGTCCCAGTT
GGTCCAAATGATCTTTCCTCGGTGACTTATACAAGTGGTAGTACTGGTGTACCAAAAGGT
GTAATGAAGTTAGATTCAATTTTCAATTTACTAATTGTCAATTCCTATGTTCAATTCCCA
AATGCAGTTTATAGTTATAATACCCTATCACATAGTCAACGTTTAAGTGATTGGAGATAT
ATTTATATGGGTGGTAGAGTAGCTATCTATTCAGGTGATATGAATCTATTATTTGAAGAT
TTAGCCTTGGTTAGACCTCATTCATTTTGGGCTGTACCAAGATTTTGGAATTTATTATTC
ACCCAGTTCAAGAGTGATCTAAAGCAATACATGTTTGAAAATCCACAATTGGATGAAAGA
ACTGCCACACTCTATTGCTATAAAGGTATTAGAAAGTTATTAGGTGATAGAATTAATAAT
CTAGTGACTGGTGGTGCTCCGACTGCAAATGAAGTACTCAAATTTATGAGTGATTGTTGG
AAAGATATAAACATTTCAAATTCTTATGGTTTAACTGAAGTATCAGGTGTTTGTATAGAT
GGTTATATCTCTGACGAAGTAGAATTCAAAATTGAACCAGTACCTTCTTTTGGATATTAC
CCAACTGATTTACCACATCCTCGTGGTGAATTGGTTGTAAAATCATCAACAATGTCTGCA
GGTTATTATAAAATACTCAATTAACTTCAGAATCATTTGAAGGTGGTTGGTTTAAAACT
GGTGATGTCGTAGAATTAATTGGAGTTAGAAAAGTTAAAATCATTGATAGAATTAAACAT
GCCTTCAAATTGGCAAATGGAGAATTCGTTACACCAGAACCATTGGAAAATAATTTCGTT
TCACTTTGTATTAATCAAATTTTTATTTATGGTAATTCACTTAAAACATTTTTAGTTGCA
ATTGTTAAACCATCACAAGATTGTTTAAAACAATTAGGACTTCAAGATATACCAATCGAT
CAATTAATTGAAAATCCAACTTTAAAATCAAAACTTTTATCAGAGATTAATAAAATTTCA
AAAGAAAAAAAACTAGCAAATTATGAAATTCCAAAAATTATTACAATAGATTTCACTGAA
TGGACAATTGATAATAAATTAATCACTGGTTCTGGTAAATTTAATAGAGGTGAATTATAT
AAATTTTATAAAATTAAAATTAATAATATGTTTGATATAATTGATAAAATTCAACAAGGT
TTAAGAAATAATAATAATAATAATAATAATGATAATATTAATAATAATGATAATAATAAT
AATAATGAATCAAATAAAGATAATTTTGAAATTATATAAAATCAATTTTAAATTTAGAC
GGTAGAATTGAAGATAATAATTTTAATTTAGAGAATTTATCATTTATTCAAATTGGTGGT
GATTCGTTAGGTGCTGTTAAATTATCATCACTTTTAAAAGAAAAAGAAAATATTGATATT
TCACCTTCAACAATTTTAAATCAAAATTTTAATTTATCTTCATTATCGAAATTAATAAAT
GAAAAGAATCAAATCAATCAATTGTTGAAGATTTTAAAGAAAATTTTAAAATCAATTGG
AATGAAGAGATGATTTTAGATGAAGATATTAAAAAATCAATTGACCAAATTAAAAATGCA
CAACCATCATCAACTCCCTCTTCATCAAAATCAACACCATCACAATCATCATCATCACCA
CCACCATCATTAAATTCAAATAATATTGGTCAAAATGCTTTTCATATGAAATCAATATTT
ATTACAGGTGTTACAGGTTATTTAGGTACATTTTATTATTTAATTTATTAGAGGATAAA
TCAATTGGTATTGAGAGAATTTATTGTTTAGTTAGAAATGTAAAGAATGAAGAAGAAGGT
TTTAAATTAATTGAAAGAATATTTGAAAAATCTTGTATCAATGGTATGAATGAAAGATT
AGAGAAAGGTAATTCCAGTTTGTGGTGACTTATCAAAACCATTTTCGGTGTTTCTACT
GAAACCTTCAAAATGTTATCTTTAGCGGTCGATATGGTAATTCACAATGGTGCCATTGTT
AATATGGCCTATCCATATGCGAATATGAAATCAACAAATGTTACATCAACTCGTGATATC
CTAAGATTATGCACTACCGGAAGAGCCTCTTTTAAAAAGTTGGTCTACGTTTCAACAGTT
GGTGTATTCTTTGGAAATGGTGATGAAAGATAGATGAATCAACAGCACCATCAACTTTC
TTTTTAGATCATGGTAATGGTTATAACCAAACAAAACTAATATCAGATATACTTGTTAGA
GAAGCGGCTTCATATGGTTTACCAACAATGATTTTCAGACCAGGTACAATCTTTAGTCAT
ACCCAATCTGGTTTCAACAATCAAAATGATTCAATCGGTTTAATAATTAAAGGTATCCTA
GGTTCGAGTTCCTATCCAACTAAAAAGATTACTCTAGTGGCGATTTAAATCTTTCACCA
GTTGATTGGGTATCATCTTCAATGGTTTCTTTAATTAAGCATCTTCCATTTTGGTGTAAT
```

FIG. 8LLL

```
AATACAAAAATTTATCATATGGTAAATGATAATCGTTTATCTTTAGATTTGCTATGTCAA
TATATAAATAAAGAAAAACAATTAGAAGAAATTAATTATTTCGATTGGATCGATGCTCAA
CTTAATTCTTCAAATAATCCATTGTATTCTATTAAACATTTATTTAAAAAGAATGATCGT
TTCCCAATTGGTTCTCAGTCAATTAAAAATCCAAAAACTATTAAAGATTTAGAATCAATT
GGTGAACTTCAATGTCAACCAATATCTGATTCCACAGTAATCAATTATGTAAAATATTTA
ATCTCAAATAATTTAATTCAAACAATTAATAAATAA
```

Amino acid sequence (SEQ ID NO:90)

>uniprot|Q54JK0|Q54JK0_DICDI Putative uncharacterized protein

```
MLKHIKNFLTRKEERKEKEVEKLKDGVSITEVKQSNLVVYSCNGCGSEIWPPKQERYACNECSN
FDLCSECYRKEMILINGTQEEKDKLVSGESNNGIKYEPVRHYDPSPLPHQLTLENETQFQLVYSL
RGNSTFETMEKSFKYFKNRPCLGIRERLGEDNVLSERYKWLTYGEVYEKSLTLAKALTNFIERRD
FISIYMDNCLEWYFTDFASLWAGLIVVPLHHASNSFNLLEILWNSESKCIVCSGESFKNLIELYDQL
TEQDKLEKPIVLKLIVHKEDLFDQSLVDRLPSGVEFKTFNEMIKIGESLSQAKYEFVPVGPNDLSS
VTYTSGSTGVPKGVMKLDSIFNLLIVNSYVQFPNAVYSYNTLSHSQRLSDWRYIYMGGRVAIYSG
DMNLLFEDLALVRPHSFWAVPRFWNLLFTQFKSDLKQYMFENPQLDERTATLYCYKGIRKLLGD
RINNLVTGGAPTANEVLKFMSDCWKDINISNSYGLTEVSGVCIDGYISDEVEFKIEPVPSFGYYPT
DLPHPRGELVVKSSTMSAGYYKNTQLTSESFEGGWFKTGDVVELIGVRKVKIIDRIKHAFKLANG
EFVTPEPLENNFVSLCINQIFIYGNSLKTFLVAIVKPSQDCLKQLGLQDIPIDQLIENPTLKSKLLSEI
NKISKEKKLANYEIPKIITIDFTEWTIDNKLITGSGKFNRGELYKFYKIKINNMFDIIDKIQQGLRNNNN
NNNNDNINNNDNNNNNESNKDNFENYIKSILNLDGRIEDNNFNLENLSFIQIGGDSLGAVKLSSLL
KEKENIDISPSTILNQNFNLSSLSKLINEKESNQSIVEDFKENFKINWNEEMILDEDIKKSIDQIKNAQ
PSSTPSSSKSTPSQSSSSPPPSLNSNNIGQNAFHMKSIFITGVTGYLGTFLLFNLLEDKSIGIERIY
CLVRNVKNEEEGFKLIERIFEKSCINGMNEKIREKVIPVCGDLSKPFFGVSTETFKMLSLAVDMVIH
NGAIVNMAYPYANMKSTNVTSTRDILRLCTTGRASFKKLVYVSTVGVFFGNGDEKIDESTAPSTF
FLDHGNGYNQTKLISDILVREAASYGLPTMIFRPGTIFSHTQSGFNNQNDSIGLIIKGILGSSSYPTK
KDYSSGDLNLSPVDWVSSSMVSLIKHLPFWCNNTKIYHMVNDNRLSLDLLCQYINKEKQLEEINY
FDWIDAQLNSSNNPLYSIKHLFKKNDRFPIGSQSIKNPKTIKDLESIGELQCQPISDSTVINYVKYLI
SNNLIQTINK
```

Q2MFQ3

Nucleotide sequence (SEQ ID NO:91)

>uniprot|Q2MFQ3|Q2MFQ3_STRRY Putative non-ribosomal peptide synthetase

```
ATGACCGACACGTACGTTTCTTCACGCCCGTTATCCAAGCGGCCCCAGGTCCCGGGTGCC
CGCACGCCGGCGCCCGGCTACCCACGGGACAGCCGCATCCCGGAGCTGTTCGAGGCACAG
GCCGCGGCGCTGCCGCAGGCCCCGGCGGCCCGGCACGGGACCGCACCCTGACCTACGGC
CAACTCGACGCCCACGCCGACGCGTTGGCGGACCGGCTGGCTGCCGGCGGGGTCCGGCCG
GGTGACCTGATCGGCGTGTGCGGCAGCCGTTCCCTGGAGGCGCTGGTGGCGCTGCTGGGC
ATCCTCAAGGCCGGCTGCGCGTACGTACCGCTCGACGAGGAACTGCCGCCGGCCCGGCTG
CGGGCCATGGCCGAGGACGCGGGCATCAGCGCCGCGGTCACCCTGCCGGGCAGCACGCGC
CGGGTGCGGGGTCTACGCGTGTCAGTCGAGGTCGGCTCCCTCGGCCGGCCCGCCCCCGAG
CGCGCGAGCGGCCCCGCCCCGACCGGGCCACCGGCTCCGCCGCCGACTGCGCCTACGTC
GCCTTCACTTCCGGCACGACCGGCCGGCCCAAGCCCGTAGCGCTGTCCCACCGGGCGTG
GTCCGCCTCGTGCTGTCCGACCCCGGCCTCACGCCACCCGGACCGGGCGACGGAGTGCTG
CACGCCTACAGCCTGTCCTCCGACGCCTCGACCATCGAGATCTGGGCGCGCTGCTGACC
GGCGCCTGCCTGGTCGTCGCCGACCGCGAGGAACTGCTCTCGCCCACCGCCCTGGAACGG
CTGCTCCGCGCGGGCGGCGTCACCGTGGCGTACCTGACGACGAGCGTCTTCCACCTCGTC
GCCCGGACCCGCCCCGAGGCGCTGGCCGGCCTGCGGTTCGTCTCCGCGGGCGGGGAGGCG
```

FIG. 8MMM

```
ATGGACCCGCGCCTGGCGAACGCCGTCCTCGCGGGCCTGCCCCGCACCACGGTGGTCAAC
TTCTACGGCCCGACCGAGAACGCCGTGGTCTCCACCGCCCATGTGCTCACCCCCCTCCCC
GAGGACGCCGCACACGTCCCCCTGGGACGCCCCTTCGGCGCTTCCACCTGCCACGTCCTG
CGGGCCGACGGCTCGCCCGCGCGGCCGGGCGAGGAAGGGGAGCTGTACGTCGGCGGGGAC
GGGCTGGCGCTGGGCTACCTCGGCGACCCGCAGCTGACCGCCGAGCGGTTCGTGACGCTG
CCCGCGGTCGAGCCGGACGGACCGCTGTACCGGACCGGCGACCGGGCCGTACGGCACGCC
GACGGGCTGCTGGAGTACCGCGGACGGCTCGACCGCCAGGTCAAGCTGCGCGGCGCCCGC
ATCGAGCTGGACGAGGTGGAGACCCGCTTACGGGCCCACCCCGAGGTCGGCGAAGCGGCC
GTCGAGGTCGACGGGCACTCCCTGACCGCCTACGTCACGGCCACCGTCCCCGGCCGCCCG
CTGCCGCTGGCCGACCTGCGCGCGTACTGCGCCAAGTGGCTGCCCCCGCAGGCCGTCCCG
GCCCTGATACCCCTGGACCGCTTCCCGGTCACCAGCGGCGGCAAGATCGACCGCAGCCGT
CTGAAGCCGACCGCGCCACCGCCCGGCCCCGAAGACACCGCGGAGGCCGCGCGGCGCCCG
GACGAGCCGGAGGCCACCGACGGCCTGTCCGGTCTCCTCTCGGAAGTGTGGCACCAGGTG
CTGCGTGTCCGGCCCACGCCCCGGGACGACTTCTTCCTCCTCGGCGGCGACTCCCTGCTC
GCCTCGGAGACCGTCACCCGCACCCTCGCCGTACTCGGCCTCGACGCGGCCCTGGGCTCC
ACCCTCATCAGGGCGCTGCTGGCCGCGCCCACCCTCGAAAGCTTCACCGCCGCCGTACGC
GGAGTCCGCGGCGGCACCGGCGGACCGGCCGGCGGCCAGGAACCGGCCGTCGACTTCGCC
GCGGAGACCGGACTCGGCTTCGCCCTCCCGCCCGCCGAAGGCCCGGCGCCGAACCCGCAC
GACCCCGAGGACGTCCTGCTCACGGGCGCTTCCGGCTTCGTCGGCGGATTCCTGCTGCAC
CGTCTGCTGCACGCGACGGCCGCCCGCGTCCACTGCCCCGTACGGGCGACGAGCCCCGCC
CACGCCCGGCAGCGGGTCCGCACCGCCCTCACCCGCTACGGGCTGCACCTCGACGAGGCC
GACTGGCAGCGCGTGGAGTGCTTCCCCGGGGACCTGACCCAGCCGCGCCTGGGGCTCGAC
CACGAGCGCGCCGACGCACTGGCCCAGCGCCTGGACCTGATCGTGCACAACGGTGCCCGG
GTCAACTTCCTCTACCCCTACCAGCAGTTGCGCCCGGCGAACGTCGACGGAACCCGCGAG
GTCGTCCGGATCGCCGCGCGCCGCCGGGTGCCGGTGCACTTCGTGTCCACCGTCGCAGTC
GTCGCGGGCTTCGGCACCGCCGGGGTGCGCGAGGTGGACGAAGATCTGCCGCCGGCCCAC
GCCGACGGGCTGACCATGGGGTACGCGGAGAGCAAGTGGGTCGCCGAAGGGGTGCTGCGG
CAGGCGGCCGCGCAGGGCCTGCCGGTGGCCGTGTACCGGCCGTACGAGGTCACGGGCGAC
CGGACGCACGGCGCGTGCAACACCGAGACGGCCATCTGCTCGCTGTTCAAGATGATCGCC
GACACGGGAGTGGCCCCCGACATCAAGCTGCCGATGGACTTCGTACCCGTCGACCACCTC
GCCGAGTCCCTGGTGCACATCGCCACGCACCGGCCGGCCGACGGCCGGGTCTACCACCTG
ACCAACCCGCGCCCGGCGATGCTGTCGGACGTCCTCGACCGGATGCGCGCGGCGGGCTTC
ACCCTGCGCACCCTGCCGTACGACGCGTGGGTCGGCGAGCTCGTCCGGCACGTCGCCGAG
AACCCGACGAGCGCCACGGCTCCGTTCGTGTCCCTGTGCGTGGACCGCAGCCGCACCGCC
GACATGTCCGTCAAGGAGATGTACCTCAAGGGCACCTTCCCGGTCCTGGGCGGCGCAAC
GCCGAGGAGGCGCTGGCCGGCAGCGGGCTGCACTGCCCGCCGGTCGACTCCGCTCTGCTG
GACCGCTACCTGGAGTACTTCTTCACCTCCGGCTACCTCACGCGCCCGGCGGCCGGCCCC
GGGCCCGAATCCGAGGCCGAGCGAATACCGGAGGACGAGCCGGTGTCCGGGACCGAACCG
ATATCCGGGACCGAACCGATTTCTGCCGCCGAGCCGATATCCGGGACCGAACCGATTTCT
GCCGCCGGGCCGATATCCGGGACCGAGCCGATACCCGCCGCCGAGCCGATATCCGGGACC
GCAGCCGCAGCCCGCACGGAGCGCAGCCGATGA
```

Amino acid sequence (SEQ ID NO:92)

>uniprot|Q2MFQ3|Q2MFQ3_STRRY Putative non-ribosomal peptide synthetase

MTDTYVSSRPLSKRPQVPGARTPAPGYPRDSRIPELFEAQAAALPQAPAARHGDRTLTYGQLDAHADALAD
RLAAGGVRPGDLIGVCGSRSLEALVALLGILKAGCAYVPLDEELPPARLRAMAEDAGISAAVTLPGSTRRV
RGLRVSVEVGSLGRPAPERASGPAPDRATGSAADCAYVAFTSGTTGRPKPVALSHRGVVRLVLSDPGLTPP
GPGDGVLHAYSLSSDASTIEIWGALLTGACLVVADREELLSPTALERLLRAGGVTVAYLTTSVFHLVARTR
PEALAGLRFVSAGGEAMDPRLANAVLAACPRTTVVNFYGPTENAVVSTAHVLTPLPEDAAHVPLGRPFGAS
TCHVLRADGSPARPGEEGELYVGGDGLALGYLGDPQLTAERFVTLPAVEPDGPLYRTGDRAVRHADGLLEY
RGRLDRQVKLRGARIELDEVETRLRAHPEVGEAAVEVDGHSLTAYVTATVPGRPLPLADLRAYCAKWLPPQ
AVPALIPLDRFPVTSGGKIDRSRLKPTAPPPGPEDTAEAARRPDEPEATDGLSGLLSEVWHQVLRVRPTPR

FIG. 8NNN

DDFFLLGGDSLLASETVTRTLAVLGLDAALGSTLIRALLAAPTLESFTAAVRGVRGGTGGPAGGQEPAVDF
AAETGLGFALPPAEGPAPNPHDPEDVLLTGASGFVGGFLLHRLLHATAARVHCPVRATSPAHARQRVRTAL
TRYGLHLDEADWQRVECFPGDLTQPRLGLDHERADALAQRLDLIVHNGARVNFLYPYQQLRPANVDGTREV
VRIAARRRVPVHFVSTVAVVAGFGTAGVREVDEDLPPAHADGLTMGYAESKWVAEGVLRQAAAQGLPVAVY
RPYEVTGDRTHGACNTETAICSLFKMIADTGVAPDIKLPMDFVPVDHLAESLVHIATHRPADGRVYHLTNP
RPAMLSDVLDRMRAAGFTLRTLPYDAWVGELVRHVAENPTSATAPFVSLCVDRSRTADMSVKEMYLKGTFP
VLGRRNAEEALAGSGLHCPPVDSALLDRYLEYFFTSGYLTRPAAGPGPESEAERIPEDEPVSGTEPISGTE
PISAAEPISGTEPISAAGPISGTEPIPAAEPISGTAAAARTERSR

ZP_03429464

Nucleotide sequence (SEQ ID NO:263)

>gi|189214978:54695-58201 Mycobacterium tuberculosis EAS054
NZ_ABOV01000087, whole genome shotgun sequence

ATGTCGATCAACGATCAGCGACTGACACGCCGCGTCGAGGACCTATACGCCAGCGACGCCCAGTTCGCCG
CCGCCAGTCCCAACGAGGCGATCACCCAGGCGATCGACCAGCCCGGGGTCGCGCTTCCACAGCTCATCCG
TATGGTCATGGAGGGCTACGCCGATCGGCCGGCACTCGGCCAGCGTGCGCTCCGCTTCGTCACCGACCCC
GACAGCGGCCGCACCATGGTCGAGCTACTGCCGCGGTTCGAGACCATCACCTACCGCGAACTGTGGGCCC
GCGCCGGCACATTGGCCACCGCGTTGAGCGCTGAGCCCGCGATCCGGCCGGGCGACCGGGTTTGCGTGCT
GGGCTTCAACAGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACGATGATCGCCA
CCAGCATCGACAATCTTGGCGACGCCGTCGAAGTGCTGGCCGGTCACGCCCCGGCCCGGCTGGTCGTATT
CGATTACCACGGCAAGGTTGACACCCACCGCGAGGCCGTCGAAGCCGCCCGAGCTCGGTTGGCCGGCTCG
GTGACCATCGACACACTTGCCGAACTGATCGAACGCGGCAGGGCGCTGCCGGCCACACCCATTGCCGACA
GCGCCGACGACGCGCTGGCGCTGCTGACTTACACCTCGGGTAGTACCGGCGCACCCAAAGGCGCCATGTA
TCGCGAGAGCCAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACGCTTTCCAACG
GCGGTACCGCCTACTTCGTCGCCAAGAGCGACCTGTCGACGCTGTTCGAGGACCTCGCCCTGGTGCGGCC
CACAGAATTGTGCTTCGTGCCGCGCATCTGGGACATGGTGTTCGCAGAGTTCCACAGCGAGGTCGACCGC
CGCTTGGTGGACGGCGCCGATCGAGCGGCGCTGGAAGCGCAGGTGAAGGCCGAGCTGCGGGAGAACGTGC
TCGGCGGACGGTTTGTCATGGCGCTGACCGGTTCCGCGCCGATCTCCGCTGAGATGACGGCGTGGGTCGA
GTCCCTGCTGGCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGCTACTTCGGCA
CCGATCAGCCCTACCCCCGGGGCGAGCTGCTGGTCAAGACGCAAACCATGTTCCCCGGCTACTACCAGCG
CCCGGATGTCACCGCCGAGGTGTTCGACCCCGACGGCTTCTACCGGACCGGGGACATCATGGCCAAAGTA
GGCCCCGACCAGTTCGTCTACCTCGACCGCCGCAACAACGTGCTAAAGCTCTCCCAGGGCGAGTTCATCG
CCGTGTCGAAGCTCGAGGCGGTGTTCGGCGACAGCCCGCTGGTCCGACAGATCTTCATCTACGGCAACAG
TGCCCGGGCCTACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCCTACGAGATTC
CACGCGACTTCATCATCGAAACCACGCCGTTCACCCTGGAGAACGGCCTGCTCACCGGCATCCGCAAGCT
GGCACGCCCCGCAGTTGAAGAAGTTCTATGGCGAACGTCTCGAGCGGCTCTATACCGAGCTGGCCGATAGC
CAATCCAACGAGCTGCGCGAGCTGCGGCAAAGCGGTCCCGATGCGCCGGTGCTTCCGACGCTGTGCCGTG
CCGCGGCTGCGTTGCTGGGCTCTACCGCTGCGGATGTGCGGCCGGACGCGCACTTCGCCGACCTGGGTGG
TGACTCGCTCTCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGCACCGGCGTCA
GGCGACCCAGCTTCGCCTCGATACACGGTCGCTCCGCGACGGAAGTGCACGCCAGCGACCTCACGCTGGA
CAAGTTCATCGACGCTGCCACCCTGGCCGCAGCCCCGAACCTGCCGGCACCGAGCGCCCAAGTGCGCACC
GTACTGCTGACCGGCGCCACCGGCTTTTTGGGTCGCTACCTGGCGCTGGAATGGCTCGACCGCATGGACC
TGGTCAACGGCAAGCTGATCTGCCTGGTCCGCGCCAGATCCGACGAGGAAGCACAAGCCCGGCTGGACGC
GACGTTCGATAGCGGCGACCCGTATTTGGTGCGGCACTACCGCGAATTGGGCGCCGGCCGCCTCGAGGTG

FIG. 8OOO

```
CTCGCCGGCGACAAGGGCGAGGCCGACCTGGGCCTGGACCGGGTCACCTGGCAGCGGCTAGCCGACACGG
TGGACCTGATCGTGGACCCCGCGGCCCTGGTCAACCACGTGCTGCCGTATAGCCAGCTGTTCGGCCCAAA
CGCGGCGGGCACCGCCGAGTTGCTTCGGCTGGCGCTGACCGGCAAGCGCAAGCCATACATCTACACCTCG
ACGATCGCCGTGGGCGAGCAGATCCCGCCGGAGGCGTTCACCGAGGACGCCGACATCCGGGCCATCAGCC
CGACCCGCAGGATCGACGACAGCTACGCCAACGGCTACGCGAACAGCAAGTGGGCCGGCGAGGTGCTGCT
GCGCGAAGCTCACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCCGCTACCGGCA
TCGCACCCGGTTCGTTCTATGAGCTGGATGCGCACGGCAATCGGCAACGCGCCCACTATGACGGCTTGCC
GGTCGAATTCGTCGCAGAAGCCATTTGCACCCTTGGGACACATAGCCCGGACCGTTTTGTCACCTACCAC
GTGATGAACCCCTACGACGACGGCATCGGGCTGGACGAGTTCGTCGACTGGCTCAACTCCCCAACTAGCG
GGTCCGGTTGCACGATCCAGCGGATCGCCGACTACGGCGAGTGGCTGCAGCGGTTCGAGACTTCGCTGCG
TGCCTTGCCGGATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAAATCGGTCCGG
ACAAAGACATTCCGCACCTCACGGCGGCGATCATCGCGAAGTACATCAGCAACCTGCGACTGCTCGGGCT
GCTGTGA
```

Amino acid sequence (SEQ ID NO:264)

>gi|215431545|ref|ZP_03429464.1| fatty-acid-CoA ligase fadD9
[Mycobacterium tuberculosis EAS054]

```
MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLTYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESLQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDVPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV
LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILADT
SYTGQLNLPDMFTRLMLSLAATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALPDRQRHASLLPLLHNYREPAK
PICGSIAPTDQFRAAVQEAKIGPDKDIPHLTAAIIAKYISNLRLLGLL
```

ZP_03533123

Nucleotide sequence (SEQ ID NO:265)

>gi|192384451:15291-18572 Mycobacterium tuberculosis GM 1503
NZ_ABQG01000169, whole genome shotgun sequence

```
ATGGTCGAGCTACTGCCGCGGTTCGAGACCATCACCTACCGCGAACTGTGGGCCCGCGCCGGCACATTGG
CCACCGCGTTGAGCGCTGAGCCCGCGATCCGGCCGGGCGACCGGGTTTGCGTGCTGGGCTTCAACAGCGT
CGACTACACAACCATCGACATCGCGCTGATCCGGTTGGGCGCCGTGTCGGTTCCACTGCAGACCAGTGCG
CCGGTCACCGGGTTGCGCCCGATCGTCACCGAGACCGAGCCGACGATGATCGCCACCAGCATCGACAATC
```

FIG. 8PPP

```
TTGGCGACGCCGTCGAAGTGCTGGCCGGTCACGCCCCGGCCCGGCTGGTCGTATTCGATTACCACGGCAA
GGTTGACACCCACCGCGAGGCCGTCGAAGCCGCCCGAGCTCGGTTGGCCGGCTCGGTGACCATCGACACA
CTTGCCGAACTGATCGAACGCGGCAGGGCGCTGCCGGCCACACCCATTGCCGACAGCGCCGACGACGCGC
TGGCGCTGCTGATTTACACCTCGGGTAGTACCGGCGCACCCAAAGGCGCCATGTATCGCGAGAGCCAGGT
GATGAGCTTCTGGCGCAAGTCGAGTGGCTGGTTCGAGCCGAGCGGTTACCCCTCGATCACGCTGAACTTC
ATGCCGATGAGCCACGTCGGGGGCCGTCAGGTGCTCTACGGGACGCTTTCCAACGGCGGTACCGCCTACT
TCGTCGCCAAGAGCGACCTGTCGACGCTGTTCGAGGACCTCGCCCTGGTGCGGCCCACAGAATTGTGCTT
CGTGCCGCGCATCTGGGACATGGTGTTCGCAGAGTTCCACAGCGAGGTCGACCGCCGCTTGGTGGACGGC
GCCGATCGAGCGGCGCTGGAAGCGCAGGTGAAGGCCGAGCTGCGGGAGAACGTGCTCGGCGGACGGTTTG
TCATGGCGCTGACCGGTTCCGCGCCGATCTCCGCTGAGATGACGGCGTGGGTCGAGTCCCTGCTGGCCGA
CGTGCATTTGGTGGAGGGTTACGGCTCCACCGAGGCCGGGATGGTCCTGAACGACGGCATGGTGCGGCGC
CCCGCGGTGATCGACTACAAGCTGGTCGACGTGCCCGAGCTGGGCTACTTCGGCACCGATCAGCCCTACC
CCCGGGGCGAGCTGCTGGTCAAGACGCAAACCATGTTCCCCGGCTACTACCAGCGCCCGGATGTCACCGC
CGAGGTGTTCGACCCCGACGGCTTCTACCGGACCGGGGACATCATGGCCAAAGTAGGCCCCGACCAGTTC
GTCTACCTCGACCGCCGCAACAACGTGCTAAAGCTCTCCCAGGGCGAGTTCATCGCCGTGTCGAAGCTCG
AGGCGGTGTTCGGCGACAGCCCGCTGGTCCGACAGATCTTCATCTACGGCAACAGTGCCCGGGCCTACCC
GCTGGCGGTGGTTGTCCCGTCCGGGGACGCGCTTTCTCGCCATGGCATCGAGAATCTCAAGCCCGTGATC
AGCGAGTCCCTGCAGGAGGTAGCGAGGGCGGCCGGCCTGCAATCCTACGAGATTCCACGCGACTTCATCA
TCGAAACCACGCCGTTCACCCTGGAGAACGGCCTGCTCACCGGCATCCGCAAGCTGGCACGCCCGCAGTT
GAAGAAGTTCTATGGCGAACGTCTCGAGCGGCTCTATACCGAGCTGGCCGATAGCCAATCCAACGAGCTG
CGCGAGCTGCGGCAAAGCGGTCCCGATGCGCCGGTGCTTCCGACGCTGTGCCGTGCCGCGGCTGCGTTGC
TGGGCTCTACCGCTGCGGATGTGCGGCCGGACGCGCACTTCGCCGACCTGGGTGGTGACTCGCTCTCGGC
GCTGTCGTTGGCCAACCTGCTGCACGAGATCTTCGGCGTCGACGTGCCGGTGGGTGTCATTGTCAGCCCG
GCAAGCGACCTGCGGGCCCTGGCCGACCACATCGAAGCAGCGCGCACCGGCGTCAGGCGACCCAGCTTCG
CCTCGATACACGGTCGCTCCGCGACGGAAGTGCACGCCAGCGACCTCACGCTGGACAAGTTCATCGACGC
TGCCACCCTGGCCGCAGCCCCGAACCTGCCGGCACCGAGCGCCCAAGTGCGCACCGTACTGCTGACCGGC
GCCACCGGCTTTTTGGGTCGCTACCTGGCGCTGGAATGGCTCGACCGCATGGACCTGGTCAACGGCAAGC
TGATCTGCCTGGTCCGCGCCAGATCCGACGAGGAAGCACAAGCCCGGCTGGACGCGACGTTCGATAGCGG
CGACCCGTATTTGGTGCGGCACTACCGCGAATTGGGCGCCGGCCGCCTCGAGGTGCTCGCCGGCGACAAG
GGCGAGGCCGACCTGGGCCTGGACCGGGTCACCTGGCAGCGGCTAGCCGACACGGTGGACCTGATCGTGG
ACCCCGCGGCCCTGGTCAACCACGTGCTGCCGTATAGCCAGCTGTTCGGCCCAAACGCGGCGGGCACCGC
CGAGTTGCTTCGGCTGGCGCTGACCGGCAAGCGCAAGCCATACATCTACACCTCGACGATCGCCGTGGGC
GAGCAGATCCCGCCGGAGGCGTTCACCGAGGACGCCGACATCCGGGCCATCAGCCCGACCCGCAGGATCG
ACGACAGCTACGCCAACGGCTACGCGAACAGCAAGTGGGCCGGCGAGGTGCTGCTGCGCGAAGCTCACGA
GCAGTGCGGCCTGCCGGTGACGGTCTTCCGCTGCGACATGATCCTGGCCGACACCAGCTATACCGGTCAG
CTCAACCTGCCGGACATGTTCACCCGGCTGATGCTGAGCCTGGCCGCTACCGGCATCGCACCCGGTTCGT
TCTATGAGCTGGATGCGCACGGCAATCGGCAACGCGCCCACTATGACGGCTTGCCGGTCGAATTCGTCGC
AGAAGCCATTTGCACCCTTGGGACACATAGCCCGGACCGTTTTGTCACCTACCACGTGATGAACCCCTAC
GACGACGGCATCGGGCTGGACGAGTTCGTCGACTGGCTCAACTCCCCAACTAGCGGGTCCGGTTGCACGA
TCCAGCGGATCGCCGACTACGGCGAGTGGCTGCAGCGGTTCGAGACTTCGCTGCGTGCCTTGCCGGATCG
CCAGCGCCACGCCTCGCTGCTGCCCTTGCTGCACAACTACCGAGAGCCTGCAAAGCCGATATGCGGGTCA
ATCGCGCCCACCGACCAGTTCCGCGCTGCCGTCCAAGAAGCGAAAATCGGTCCGGACAAAGACATTCCGC
ACCTCACGGCGGCGATCATCGCGAAGTACATCAGCAACCTGCGACTGCTCGGGCTGCTGTGA
```

Amino acid sequence (SEQ ID NO:266)

```
>gi|218754327|ref|ZP_03533123.1| fatty-acid-CoA ligase fadD9
[Mycobacterium tuberculosis GM 1503]

MVELLPRFETITYRELWARAGTLATALSAEPAIRPGDRVCVLGFNSVDYTTIDIALIRLGAVSVPLQTSA
PVTGLRPIVTETEPTMIATSIDNLGDAVEVLAGHAPARLVVFDYHGKVDTHREAVEAARARLAGSVTIDT
LAELIERGRALPATPIADSADDALALLIYTSGSTGAPKGAMYRESQVMSFWRKSSGWFEPSGYPSITLNF
MPMSHVGGRQVLYGTLSNGGTAYFVAKSDLSTLFEDLALVRPTELCFVPRIWDMVFAEFHSEVDRRLVDG
```

FIG. 8QQQ

ADRAALEAQVKAELRENVLGGRFVMALTGSAPISAEMTAWVESLLADVHLVEGYGSTEAGMVLNDGMVRR
PAVIDYKLVDVPELGYFGTDQPYPRGELLVKTQTMFPGYYQRPDVTAEVFDPDGFYRTGDIMAKVGPDQF
VYLDRRNNVLKLSQGEFIAVSKLEAVFGDSPLVRQIFIYGNSARAYPLAVVVPSGDALSRHGIENLKPVI
SESLQEVARAAGLQSYEIPRDFIIETTPFTLENGLLTGIRKLARPQLKKFYGERLERLYTELADSQSNEL
RELRQSGPDAPVLPTLCRAAAALLGSTAADVRPDAHFADLGGDSLSALSLANLLHEIFGVDVPVGVIVSP
ASDLRALADHIEAARTGVRRPSFASIHGRSATEVHASDLTLDKFIDAATLAAAPNLPAPSAQVRTVLLTG
ATGFLGRYLALEWLDRMDLVNGKLICLVRARSDEEAQARLDATFDSGDPYLVRHYRELGAGRLEVLAGDK
GEADLGLDRVTWQRLADTVDLIVDPAALVNHVLPYSQLFGPNAAGTAELLRLALTGKRKPYIYTSTIAVG
EQIPPEAFTEDADIRAISPTRRIDDSYANGYANSKWAGEVLLREAHEQCGLPVTVFRCDMILADTSYTGQ
LNLPDMFTRLMLSLAATGIAPGSFYELDAHGNRQRAHYDGLPVEFVAEAICTLGTHSPDRFVTYHVMNPY
DDGIGLDEFVDWLNSPTSGSGCTIQRIADYGEWLQRFETSLRALPDRQRHASLLPLLHNYREPAKPICGS
IAPTDQFRAAVQEAKIGPDKDIPHLTAAIIAKYISNLRLLGLL

ZP_03433592

Nucleotide sequence (SEQ ID NO:267)

>gi|189214744:1-3126 Mycobacterium tuberculosis T85 NZ_ABOW01000178,
whole genome shotgun sequence GACATCGCGCTGATCCGGTTGGGCGCCGTGTCGGTTCCACTGCAGACCAGTGCGCCGGTCACCGGGTTGC
GCCCGATCGTCACCGAGACCGAGCCGACGATGATCGCCACCAGCATCGACAATCTTGGCGACGCCGTCGA
AGTGCTGGCCGGTCACGCCCCGGCCCGGCTGGTCGTATTCGATTACCACGGCAAGGTTGACACCCACCGC
GAGGCCGTCGAAGCCGCCCGAGCTCGGTTGGCCGGCTCGGTGACCATCGACACACTTGCCGAACTGATCG
AACGCGGCAGGGCGCTGCCGGCCACACCCATTGCCGACAGCGCCGACGACGCGCTGGCGCTGCTGATTTA
CACCCTCGGGTAGTACCGGCGCACCCAAAGGCGCCATGTATCGCGAGAGCCAGGTGATGAGCTTCTGGCGC
AAGTCGAGTGGCTGGTTCGAGCCGAGCGGTTACCCCTCGATCACGCTGAACTTCATGCCGATGAGCCACG
TCGGGGGCCGTCAGGTGCTCTACGGGACGCTTTCCAACGGCGGTACCGCCTACTTCGTCGCCAAGAGCGA
CCTGTCGACGCTGTTCGAGGACCTCGCCCTGGTGCGGCCCACAGAATTGTGCTTCGTGCCGCGCATCTGG
GACATGGTGTTCGCAGAGTTCCACAGCGAGGTCGACCGCCGCTTGGTGGACGGCGCCGATCGAGCGGCGC
TGGAAGCGCAGGTGAAGGCCGAGCTGCGGGAGAACGTGCTCGGCGGACGGTTTGTCATGGCGCTGACCGG
TTCCGCGCCGATCTCCGCTGAGATGACGGCGTGGGTCGAGTCCCTGCTGGCCGACGTGCATTTGGTGGAG
GGTTACGGCTCCACCGAGGCCGGGATGGTCCTGAACGACGGCATGGTGCGGCGCCCCGCGGTGATCGACT
ACAAGCTGGTCGACGTGCCCGAGCTGGGCTACTTCGGCACCGATCAGCCCTACCCCCGGGGCGAGCTGCT
GGTCAAGACGCAAACCATGTTCCCCGGCTACTACCAGCGCCCGGATGTCACCGCCGAGGTGTTCGACCCC
GACGGCTTCTACCGGACCGGGGACATCATGGCCAAAGTAGGCCCCGACCAGTTCGTCTACCTCGACCGCC
GCAACAACGTGCTAAAGCTCTCCCAGGGCGAGTTCATCGCCGTGTCGAAGCTCGAGGCGGTGTTCGGCGA
CAGCCCGCTGGTCCGACAGATCTTCATCTACGGCAACAGTGCCCGGGCCTACCCGCTGGCGGTGGTTGTC
CCGTCCGGGGACGCGCTTTCTCGCCATGGCATCGAGAATCTCAAGCCCGTGATCAGCGAGTCCCTGCAGG
AGGTAGCGAGGGCGGCCGGCCTGCAATCCTACGAGATTCCACGCGACTTCATCATCGAAACCACGCCGTT
CACCCTGGAGAACGGCCTGCTCACCGGCATCCGCAAGCTGGCACGCCCGCAGTTGAAGAAGTTCTATGGC
GAACGTCTCGAGCGGCTCTATACCGAGCTGGCCGATAGCCAATCCAACGAGCTGCGCGAGCTGCGGCAAA
GCGGTCCCGATGCGCCGGTGCTTCCGACGCTGTGCCGTGCCGCGGCTGCGTTGCTGGGCTCTACCGCTGC
GGATGTGCGGCCGGACGCGCACTTCGCCGACCTGGGTGGTGACTCGCTCTCGGCGCTGTCGTTGGCCAAC
CTGCTGCACGAGATCTTCGGCGTCGACGTGCCGGTGGGTGTCATTGTCAGCCCGGCAAGCGACCTGCGGG
CCCTGGCCGACCACATCGAAGCAGCGCGCACCGGCGTCAGGCGACCCAGCTTCGCCTCGATACACGGTCG
CTCCGCGACGGAAGTGCACGCCAGCGACCTCACGCTGGACAAGTTCATCGACGCTGCCACCCTGGCCGCA
GCCCCGAACCTGCCGGCACCGAGCGCCCAAGTGCGCACCGTACTGCTGACCGGCGCCACCGGCTTTTTGG
GTCGCTACCTGGCGCTGGAATGGCTCGACCGCATGGACCTGGTCAACGGCAAGCTGATCTGCCTGGTCCG
CGCCAGATCCGACGAGGAAGCACAAGCCCGGCTGGACGCGACGTTCGATAGCGGCGACCCGTATTTGGTG
CGGCACTACCGCGAATTGGGCGCCGGCCGCCTCGAGGTGCTCGCCGGCGACAAGGGCGAGGCCGACCTGG
GCCTGGACCGGGTCACCTGGCAGCGGCTAGCCGACACGGTGGACCTGATCGTGGACCCCGCGGCCCTGGT

FIG. 8RRR

CAACCACGTGCTGCCGTATAGCCAGCTGTTCGGCCCAAACGCGGCGGGCACCGCCGAGTTGCTTCGGCTG
GCGCTGACCGGCAAGCGCAAGCCATACATCTACACCTCGACGATCGCCGTGGGCGAGCAGATCCCGCCGG
AGGCGTTCACCGAGGACGCCGACATCCGGGCCATCAGCCCGACCCGCAGGATCGACGACAGCTACGCCAA
CGGCTACGCGAACAGCAAGTGGGCCGGCGAGGTGCTGCTGCGCGAAGCTCACGAGCAGTGCGGCCTGCCG
GTGACGGTCTTCCGCTGCGACATGATCCTGGCCGACACCAGCTATACCGGTCAGCTCAACCTGCCGGACA
TGTTCACCCGGCTGATGCTGAGCCTGGCCGCTACCGGCATCGCACCCGGTTCGTTCTATGAGCTGGATGC
GCACGGCAATCGGCAACGCGCCCACTATGACGGCTTGCCGGTCGAATTCGTCGCAGAAGCCATTTGCACC
CTTGGGACACATAGCCCGGACCGTTTTGTCACCTACCACGTGATGAACCCCTACGACGACGGCATCGGGC
TGGACGAGTTCGTCGACTGGCTCAACTCCCCAACTAGCGGGTCCGGTTGCACGATCCAGCGGATCGCCGA
CTACGGCGAGTGGCTGCAGCGGTTCGAGACTTCGCTGCGTGCCTTGCCGGATCGCCAGCGCCACGCCTCG
CTGCTGCCCTTGCTGCACAACTACCGAGAGCCTGCAAAGCCGATATGCGGGTCAATCGCGCCCACCGACC
AGTTCCGCGCTGCCGTCCAAGAAGCGAAAATCGGTCCGGACAAAGACATTCCGCACCTCACGGCGGCGAT
CATCGCGAAGTACATCAGCAACCTGCGACTGCTCGGGCTGCTGTGA

Amino acid sequence (SEQ ID NO:268)

>gi|215446840|ref|ZP_03433592.1| fatty-acid-CoA ligase fadD9
[Mycobacterium tuberculosis T85]

DIALIRLGAVSVPLQTSAPVTGLRPIVTETEPTMIATSIDNLGDAVEVLAGHAPARLVVFDYHGKVDTHR
EAVEAARARLAGSVTIDTLAELIERGRALPATPIADSADDALALLIYTSGSTGAPKGAMYRESQVMSFWR
KSSGWFEPSGYPSITLNFMPMSHVGGRQVLYGTLSNGGTAYFVAKSDLSTLFEDLALVRPTELCFVPRIW
DMVFAEFHSEVDRRLVDGADRAALEAQVKAELRENVLGGRFVMALTGSAPISAEMTAWVESLLADVHLVE
GYGSTEAGMVLNDGMVRRPAVIDYKLVDVPELGYFGTDQPYPRGELLVKTQTMFPGYYQRPDVTAEVFDP
DGFYRTGDIMAKVGPDQFVYLDRRNNVLKLSQGEFIAVSKLEAVFGDSPLVRQIFIYGNSARAYPLAVVV
PSGDALSRHGIENLKPVISESLQEVARAAGLQSYEIPRDFIIETTPFTLENGLLTGIRKLARPQLKKFYG
ERLERLYTELADSQSNELRELRQSGPDAPVLPTLCRAAAALLGSTAADVRPDAHFADLGGDSLSALSLAN
LLHEIFGVDVPVGVIVSPASDLRALADHIEAARTGVRRPSFASIHGRSATEVHASDLTLDKFIDAATLAA
APNLPAPSAQVRTVLLTGATGFLGRYLALEWLDRMDLVNGKLICLVRARSDEEAQARLDATFDSGDPYLV
RHYRELGAGRLEVLAGDKGEADLGLDRVTWQRLADTVDLIVDPAALVNHVLPYSQLFGPNAAGTAELLRL
ALTGKRKPYIYTSTIAVGEQIPPEAFTEDADIRAISPTRRIDDSYANGYANSKWAGEVLLREAHEQCGLP
VTVFRCDMILADTSYTGQLNLPDMFTRLMLSLAATGIAPGSFYELDAHGNRQRAHYDGLPVEFVAEAICT
LGTHSPDRFVTYHVMNPYDDGIGLDEFVDWLNSPTSGSGCTIQRIADYGEWLQRFETSLRALPDRQRHAS
LLPLLHNYREPAKPICGSIAPTDQFRAAVQEAKIGPDKDIPHLTAAIIAKYISNLRLLGLL

ZP_03537669

Nucleotide sequence (SEQ ID NO:269)
>gi|192384126:19547-22546 Mycobacterium tuberculosis T17
NZ_ABQH01000288, whole genome shotgun sequence ATGTCGATCAACGATCAGCGACTGACACGCCGCGTCGAGGACCTATACGCCAGCGACGCCCAGTTCGCCG
CCGCCAGTCCCAACGAGGCGATCACCCAGGCGATCGACCAGCCCGGGGTCGCGCTTCCACAGCTCATCCG
TATGGTCATGGAGGGCTACGCCGATCGGCCGGCACTCGGCCAGCGTGCGCTCCGCTTCGTCACCGACCCC
GACAGCGGCCGCACCATGGTCGAGCTACTGCCGCGGTTCGAGACCATCACCTACCGCGAACTGTGGGCCC
GCGCCGGCACATTGGCCACCGCGTTGAGCGCTGAGCCCGCGATCCGGCCGGGCGACCGGGTTTGCGTGCT
GGGCTTCAACAGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACGATGATCGCCA
CCAGCATCGACAATCTTGGCGACGCCGTCGAAGTGCTGGCCGGTCACGCCCCGGCCCGGCTGGTCGTATT

FIG. 8SSS

```
CGATTACCACGGCAAGGTTGACACCCACCGCGAGGCCGTCGAAGCCGCCCGAGCTCGGTTGGCCGGCTCG
GTGACCATCGACACACTTGCCGAACTGATCGAACGCGGCAGGGCGCTGCCGGCCACACCCATTGCCGACA
GCGCCGACGACGCGCTGGCGCTGCTGATTTACACCTCGGGTAGTACCGGCGCACCCAAAGGCGCCATGTA
TCGCGAGAGCCAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACGCTTTCCAACG
GCGGTACCGCCTACTTCGTCGCCAAGAGCGACCTGTCGACGCTGTTCGAGGACCTCGCCCTGGTGCGGCC
CACAGAATTGTGCTTCGTGCCGCGCATCTGGGACATGGTGTTCGCAGAGTTCCACAGCGAGGTCGACCGC
CGCTTGGTGGACGGCGCCGATCGAGCGGCGCTGGAAGCGCAGGTGAAGGCCGAGCTGCGGGAGAACGTGC
TCGGCGGACGGTTTGTCATGGCGCTGACCGGTTCCGCGCCGATCTCCGCTGAGATGACGGCGTGGGTCGA
GTCCCTGCTGGCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGCTACTTCGGCA
CCGATCAGCCCTACCCCGGGGCGAGCTGCTGGTCAAGACGCAAACCATGTTCCCCGGCTACTACCAGCG
CCCGGATGTCACCGCCGAGGTGTTCGACCCCGACGGCTTCTACCGGACCGGGGACATCATGGCCAAAGTA
GGCCCCGACCAGTTCGTCTACCTCGACCGCCGCAACAACGTGCTAAAGCTCTCCCAGGGCGAGTTCATCG
CCGTGTCGAAGCTCGAGGCGGTGTTCGGCGACAGCCCGCTGGTCCGACAGATCTTCATCTACGGCAACAG
TGCCCGGGCCTACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCCTACGAGATTC
CACGCGACTTCATCATCGAAACCACGCCGTTCACCCTGGAGAACGGCCTGCTCACCGGCATCCGCAAGCT
GGCACGCCCGCAGTTGAAGAAGTTCTATGGCGAACGTCTCGAGCGGCTCTATACCGAGCTGGCCGATAGC
CAATCCAACGAGCTGCGCGAGCTGCGGCAAAGCGGTCCCGATGCGCCGGTGCTTCCGACGCTGTGCCGTG
CCGCGGCTGCGTTGCTGGGCTCTACCGCTGCGGATGTGCGGCCGGACGCGCACTTCGCCGACCTGGGTGG
TGACTCGCTCTCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGCACCGGCGTCA
GGCGACCCAGCTTCGCCTCGATACACGGTCGCTCCGCGACGGAAGTGCACGCCAGCGACCTCACGCTGGA
CAAGTTCATCGACGCTGCCACCCTGGCCGCAGCCCCGAACCTGCCGGCACCGAGCGCCCAAGTGCGCACC
GTACTGCTGACCGGCGCCACCGGCTTTTTGGGTCGCTACCTGGCGCTGGAATGGCTCGACCGCATGGACC
TGGTCAACGGCAAGCTGATCTGCCTGGTCCGCGCCAGATCCGACGAGGAAGCACAAGCCCGGCTGGACGC
GACGTTCGATAGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTAGCCGACACGG
TGGACCTGATCGTGGACCCCGCGGCCCTGGTCAACCACGTGCTGCCGTATAGCCAGCTGTTCGGCCCAAA
CGCGGCGGGCACCGCCGAGTTGCTTCGGCTGGCGCTGACCGGCAAGCGCAAGCCATACATCTACACCTCG
ACGATCGCCGTGGGCGAGCAGATCCCGCCGGAGGCGTTCACCGAGGACGCCGACATCCGGGCCATCAGCC
CGACCCGCAGGATCGACGACAGCTACGCCAACGGCTACGCGAACAGCAAGTGGGCCGGCGAGGTGCTGCT
GCGCGAAGCTCACGAGCAGTGCGGCCTGCCGGTGACGGTCTTCCGCTGCGACATGATCCTGGGCCGACAC
CAGCTATACCGGTCAGCTCAACCTGCCGGACATGTCACCCGGGCTGATGCTGAGCCTGGC
```

Amino acid sequence (SEQ ID NO:270)

```
>gi|219558593|ref|ZP_03537669.1| fatty-acid-CoA ligase fadD9
[Mycobacterium tuberculosis T17]

MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLIYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESIQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV
```

FIG. 8TTT

LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILGRH
QLYRSAQPAGHVTRADAEPG

ZP_05224908

Nucleotide sequence (SEQ ID NO:271)

>gi|163719654:2489-6013 Mycobacterium intracellulare ATCC 13950
NZ_ABIN01000072, whole genome shotgun sequence ATGTCGACTGCCATTCATGACGAACACCTCGACCGTCGCATCGAGGAACTCATCGCCAACGACCCCCAAT
TCGCCGCCGCCCGACCGGACCCGGCCATCACCGCCGCCACCGAAGCGCCCGGGCTGCGGCTGCCGCAGAT
CATCCGGACCGTGCTCGACGGCTACGCCGACCGGCCTGCCCTGGCGCAGCGCGTCGTGGAGTTCGTCACC
GACGCCAAGACCGGGCGGACGACGGCCGAGCTGCTCCCCCGTTTCGAGACCATCACGTATGGCGAACTCG
GCGAACGGGTTTCGGCCCTCGGCCGTGCCTGGGCCGGCGACGCGGTGCGCCCCGGCGACCGCGTCTGCGT
GCTCGGCTTCAACAGCGTTGACTACGCCACCATCGACATCGCGCTGGGCACCATCGGGGCCGTGTCGGTG
CCGCTGCAGACCAGCGCGGCGATCTCCTCGTTGCAGCCGATCGTCGCCGAGACCGAGCCCAGCCTGATCG
CCTCGAGCGTCAACCAGCTGCCCGACGCGGTGGAGCTGATCCTGGCCGGCGACCACGTGCCCGGCAAGCT
CGTCGTGTTCGACTACCAGCCCCAGGTCGACGACCAGCGCGAGGCCGTGGAGGCCGCCGCCGCGCGGTTG
GCCGACTCCGGCGTCGCGGTCGAGGCTCTCGCCGACGTGCTGCGGCGCGGCAAGGACCTGCCGGCCGTCG
AGCCGCCGGCGAGCGACGAGGACTCGCTGGCCCTGCTGATCTACACCTCCGGCAGCACCGGCGCGCCCAA
GGGCGCGATGTACCCGCAGAGCAACGTCGGCAAGATGTGGCGGCGCGGGAGCAAGAACTGGTTCGGGGAA
AGCGCCGCGTCGATCACCCTCAACTTCATGCCGATGAGCCACGTCATGGGCGCGGAATCCTCTACGGCA
CGCTGGGCAACGGCGGCACCGCGTACTTCGCCGCCCGCAGCGACCTGTCCACCCTGCTCGAGGACCTCGA
GTTGGTGCGGCCCACCGAGATGAACTTCGTCCCCGCATCTGGGAGACGCTGTACGGCGAATTCCAGCGC
CAGGTCGAGCGGCGGCTGGCCGACGGCGATGCGGGCCCGGAGGCCCGCGAGACTGTGGCGGCTGCGGTGT
TGGAAGAACAGCGCCAGTACCTGCTGGGCGGGCGGTTCATCTTCGCGATGACGGGCTCGGCACCCACCTC
GCCGGAGCTCAAGGCGTGGGCCGAGTCGCTCCTGCAGATGCACCTGATGGACGGCTACGGCTCCACCGAG
GCCGGAATGGTGTTGTTCGACGGGAGATTCAGCGTCCGCCGGTTATTGATTACAAGCTGGTCGACGTTC
CGGATCTGGGCTATTTCAGCACCGACCGTCCGCATCCGCGCGGTGAGTTGTTGCTGCGGACCGAGAACAT
GTTCCCGGGTTATTACAAGCGGGCCGAGACCACCGCGAACGTGTTCGACGAGGACGGTTATTACCGCACC
GGTGACGTGTTCGCCGAGATCGCGCCGGACCGGCTGGTGTATGTCGATCGCCGCAACAACGTGCTCAAGT
TGGCCCAGGGCGAGTTCGTGACGCTGGCCAAGCTGGAGGCGGTGTTCGGCAACAGCCCGCTGATCCGCCA
GATCTACGTTTACGGCAACAGCTCCCAGCCCTACCTGCTGGCCGTGGTGGTGCCGACCGAGGAAGCGTTG
GCGGACAACGATCTTGAGTCGCTCAAGCCGAAGATCGCCGACTCGCTGCAGAAGGTCGCCAAGGAGACCG
GCCTGCAGTCCTACGAGGTGCCGCGCGACTTCATCATCGAGACCACGCCGTTCACCCTGGAAAACGGCCT
GCTGACCGGGATCCGCAAGCTGGCGTGGCCCAAGCTCAAGGCGCACTACGGGGATCGGCTCGAGCAGATG
TATGCCGAGCTGGCCGCGGGACAGGCCAACGAGTTGGCCGAACTGCGCCGCAGCGGCGCGGCGGCGCCGG
TGCCCCAGACCGTGAGCCGGGCCGCGGCCGCCCTGCTGGGTGCGACGGCCGGGGATCTGTCCGCAGATGC
CCACTTCACCGATCTTGGTGGAGACTCGTTGTCGGCGTTGACCTTCGGCAACCTGCTGCGCGAGATCTTC
GATGTCGACGTGCCGGTGGGGGTGATCGTCAGCCCGGCCAACGACCTGGCGGGATCGCCGCCTACATCG
AGGCCGAGCGGCAGGGCTCCAAGCGCCCGACGTTCGCCGCCGTGCACGGTCGCGGTGCGACCATGGTGCA
CGCCAGTGACCTCACGCTGGACAAGTTCCTCGACGAGGCGACCCTGGCCGCCGCGCCCAGCCTGCCCAAG
CCGGCCACCGAGGTGCGCACCGTGCTGTTGACCGGCGCGACCGGCTTTTTGGGCCGCTACCTGGCGCTGG
ACTGGCTCGAGCGGATGGACATGGTCGACGGCAAGGTCATCGCCCTGGTGCGGGCCCGCACCGATGAGGA
GGCGCGCGCCCGGCTGGACAAGACCTTCGACAGCGGCGACCCCAAACTGCTGGCGCACTACCAGCGGCTG
GCCGCCGACCACCTCGAGGTCATCGCCGGCGACAAGGGTGAGGCCAACCTCGGCCTGGACCCCAGACCT
GGCAGCGACTGGCCGAGGAGGTCGACGTCATCGTCGACCCCGCCGCTGGTCAACCACGTGCTGCCCTA
CAGCGAGCTGTTCGGCCCCAACGCCCTGGGCACCGCGGAGCTGATCCGGATCGCGCTGACCTCCAGGCAA
AAGCCCTACACCTACGTGTCGACGATCGGGGTGGGCGATCAGATCCAGCCAGGTGAGTTCGTCGAGAACG

FIG. 8UUU

```
CCGACATCCGCCAGATCAGCGCCACCCGCGAGATCAACGACGGCTACGCCAACGGCTACGGCAACAGCAA
GTGGGCCGGCGAGGTGTTGCTGCGCGAGGCCCACGACCTGTGCGGCCTGCCCGTCACGGTGTTCCGCTGC
GACATGATCCTGGCCGACACCACCTATGCCGGGCAGCTCAACCTGCCCGACATGTTCACCCGGCTGATGC
TGAGCCTGGTCGCCACCGGTATCGCGCCCGGGTCGTTCTACGAACTGGACGCCGACGGCAACCGCCAGCG
GGCACACTACGACGGTTTGCCGGTCGAGTTCATCGCCGCGGCGATCTCGACGCTGGGGACCCAAATCACC
GACAGCGACACGGGCTTTCAGACCTACCACGTGATGAACCCCTACGACGACGGCATCGGGCTGGATGAGT
ACATCGATTGGCTGATCGAGGCCGGGTATTCGATCGAGCGGATCGCCGATTACTCCGAGTGGCTGCGGCG
CTTCGAGACCTCGCTGCGGGCCCTGCCCGATCGGCAGCGTCAGTACTCGCTGCTGCCGCTGCTGCACAAC
TACCAGAAGCCGGAAAAGCCGATCAACGGCTCGATGGCGCCCACCGACGTGTTCCGTGCCGCGGTGCAGG
AAGCGAAAATCGGCCCCGACAAAGACATCCCGCACGTCTCGGCGCCGGTGATCGTCAAGTACATCACCGA
CCTGGAGTTGCTCGGACTCCTCTGA
```

Amino acid sequence (SEQ ID NO:272)

```
>gi|254819907|ref|ZP_05224908.1| FadD9 [Mycobacterium intracellulare
ATCC 13950]

MSTAIHDEHLDRRIEELIANDPQFAAARPDPAITAATEAPGLRLPQIIRTVLDGYADRPALAQRVVEFVT
DAKTGRTTAELLPRFETITYGELGERVSALGRAWAGDAVRPGDRVCVLGFNSVDYATIDIALGTIGAVSV
PLQTSAAISSLQPIVAETEPSLIASSVNQLPDAVELILAGDHVPGKLVVFDYQPQVDDQREAVEAAAARL
ADSGVAVEALADVLRRGKDLPAVEPPASDEDSLALLIYTSGSTGAPKGAMYPQSNVGKMWRRGSKNWFGE
SAASITLNFMPMSHVMGRGILYGTLGNGGTAYFAARSDLSTLLEDLELVRPTEMNFVPRIWETLYGEFQR
QVERRLADGDAGPEARETVAAAVLEEQRQYLLGGRFIFAMTGSAPTSPELKAWAESLLQMHLMDGYGSTE
AGMVLFDGEIQRPPVIDYKLVDVPDLGYFSTDRPHPRGELLLRTENMFPGYYKRAETTANVFDEDGYYRT
GDVFAEIAPDRLVYVDRRNNVLKLAQGEFVTLAKLEAVFGNSPLIRQIYVYGNSSQPYLLAVVVPTEEAL
ADNDLESLKPKIADSLQKVAKETGLQSYEVPRDFIIETTPFTLENGLLTGIRKLAWPKLKAHYGDRLEQM
YAELAAGQANELAELRRSGAAAPVAQTVSRAAAALLGATAGDLSADAHFTDLGGDSLSALTFGNLLREIF
DVDVPVGVIVSPANDLAGIAAYIEAERQGSKRPTFAAVHGRGATMVHASDLTLDKFLDEATLAAAPSLPK
PATEVRTVLLTGATGFLGRYLALDWLERMDMVDGKVIALVRARTDEEARARLDKTFDSGDPKLLAHYQRL
AADHLEVIAGDKGEANLGLDPQTWQRLAEEVDVIVDPAALVNHVLPYSELFGPNALGTAELIRIALTSRQ
KPYTYVSTIGVGDQIQPGEFVENADIRQISATREINDGYANGYGNSKWAGEVLLREAHDLCGLPVTVFRC
DMILADTTYAGQLNLPDMFTRLMLSLVATGIAPGSFYELDADGNRQRAHYDGLPVEFIAAAISTLGTQIT
DSDTGFQTYHVMNPYDDGIGLDEYIDWLIEAGYSIERIADYSEWLRRFETSLRALPDRQRQYSLLPLLHN
YQKPEKPINGSMAPTDVFRAAVQEAKIGPDKDIPHVSAPVIVKYITDLELLGLL
```

FIG. 9A

Accession Numbers are from NCBI, GenBank, Release 159.0 as of March 2008
EC Numbers are from KEGG, Release 42.0 as of April 2007 (plus daily updates up to March 2008)

| CATEGORY | GENE | NAME | ACCESSION | EC NUMBER | MODIFICATION | USE | ORGANISM |
|---|---|---|---|---|---|---|---|
| 1. Fatty Acid Production Increase / Product Production Increase | | | | | | | |
| *increase acyl-CoA* | | | | | | | |
| *reduce catabolism of derivatives and intermediates* | | | | | | | |
| *reduce feedback inhibition* | | | | | | | |
| *attenuate other pathways that consume fatty acids* | | | | | | | |
| | accA | Acetyl-CoA carboxylase, subunit A (carboxyltransferase alpha) | AAC73296, NP_414727 | 6.4.1.2 | Over-express | increase Malonyl-CoA production | *Escherichia coli, Lactococci* |
| | accB | Acetyl-CoA carboxylase, subunit B (BCCP: biotin carboxyl carrier protein) | NP_417721 | 6.4.1.2 | Over-express | increase Malonyl-CoA production | *Escherichia coli, Lactococci* |
| | accC | Acetyl-CoA carboxylase, subunit C (biotin carboxylase) | NP_417722 | 6.4.1.2, 6.3.4.14 | Over-express | increase Malonyl-CoA production | *Escherichia coli, Lactococci* |
| | accD | Acetyl-CoA carboxylase, subunit D (carboxyltransferase beta) | NP_416819 | 6.4.1.2 | Over-express | increase Malonyl-CoA production | *Escherichia coli, Lactococci* |
| | aceE | pyruvate dehydrogenase, subunit E1 | NP_414656, AAC73226 | 1.2.4.1 | Over-express | increase Acetyl-CoA production | *Escherichia coli* |

FIG. 9B

| | | | | | |
|---|---|---|---|---|---|
| aceF | pyruvate dehydrogenase, subunit E2 | NP_414657 | 2.3.1.12 | Over-express | increase Acetyl-CoA production | Escherichia coli |
| ackA | acetate kinase | AAC75356, NP_416799 | 2.7.2.1 | Delete or reduce | increase Acetyl-CoA production | Escherichia coli |
| ackB | acetate kinase AckB | BAB81430 | 2.7.2.1 | Delete or reduce | increase Acetyl-CoA production | Escherichia coli |
| acpP | acyl carrier protein | AAC74178 | NONE | Over-express | increase Acetyl-CoA production | Escherichia coli |
| fadD | acyl-CoA synthase | AP_002424 | 2.3.1.86, 6.2.1.3 | Over-express | increase Fatty acid production | Escherichia coli W3110 |
| adhE | alcohol dehydrogenase | CAA47743 | 1.1.1.1, 1.2.1.10 | Delete or reduce | increase Acetyl-CoA production | Escherichia coli W3111 |
| cer1 | Aldehyde decarbonylase | BAA11024 | 4.1.99.5 | Over-express | increase Acetyl-CoA production | Arabidopsis thaliana |
| fabA | beta-hydroxydecanoyl thioester dehydrase | NP_415474 | 4.2.1.60 | express | fatty acyl-CoA production | E. coli K12 |
| fabD | [acyl-carrier-protein] S-malonyltransferase | AAC74176 | 2.3.1.39 | Over-express | increase Acetyl-CoA production | E. coli K12 |
| fabF | 3-oxoacyl-[acyl-carrier-protein] synthase II | AAC74179 | 2.3.1.179 | Delete or OverExpress | increase Acetyl-CoA production | E. coli K12 |
| fabG | 3-oxoacyl-[acyl-carrier-protein] reductase | AAC74177 | 1.1.1.100 | Over-express | increase Acetyl-CoA production | E. coli K12 |
| fabH | 3-oxoacyl-[acyl-carrier-protein] synthase III | AAC74175 | 2.3.1.180 | Over-express | increase Acetyl-CoA production | E. coli K12, lactococci |

FIG. 9C

| | | | | | |
|---|---|---|---|---|---|
| fabI | enoyl-[acyl-carrier-protein] reductase, NADH-dependent | NP_415804 | 1.3.1.9 | express | fatty acyl-CoA production | E. coli K12, lactococci |
| fabR | Transcriptional Repressor | NP_418398 | NONE | Delete or reduce | modulate unsaturated fatty acid production | E. coli K12 |
| fabZ | (3R)-hydroxymyristol acyl carrier protein dehydratase | NP_414722 | 4.2.1.- | | | E. coli K12 |
| fadE | acyl-CoA dehydrogenase | AAC73325 | 1.3.99.3, 1.3.99.- | Delete or reduce | increase Acetyl-CoA production | |
| acr1 | Fatty Acyl-CoA reductase | YP_047869, AAC45217 | 1.2.1.42 | Over-express | for fatty alcohol production | Acinetobacter sp., i.e. calcoaceticus |
| GST, gshB | Glutathione synthase | P04425 | 6.3.2.3 | Delete or reduce | increase Acyl-CoA | E. coli K12 |
| gpsA | biosynthetic sn-glycerol 3-phosphate dehydrogenase | AAC76632, NP_418065 | EC: 1.1.1.94 | Delete or reduce | increase Acetyl-CoA production | E. coli K12 |
| ldhA | lactate dehydrogenase | AAC74462, NP_415898 | EC: 1.1.1.27, 1.1.1.28 | Delete or reduce | increase Acetyl-CoA production | E. coli K12 |
| Lipase | Triglyceride Lipase | CAA89087, CAA98876 | 3.1.1.3 | express | increase Fatty acid production | Saccharomyces cerevisiae |
| | Malonyl-CoA decarboxylase | AAA26500 | 4.1.1.9, 4.1.1.41 | Over-express | | Saccharopolyspora erythraea |
| panD | aspartate 1-decarboxylase | BAB96708 | 4.1.1.11 | Over-express | increase Acyl-CoA | Escherichia coli W3110 |
| panK a.k.a. coaA | pantothenate kinase | AAC76952 | 2.7.1.33 | Express, Over-express, R106K mutation | increase Acetyl-CoA production | E. coli |
| panK a.k.a. coaA, R106K | pantothenate kinase | AAC76952 | 2.7.1.33 | | increase Acetyl-CoA production | E. coli |

FIG. 9D

| | | | | | |
|---|---|---|---|---|---|
| pdh | Pyruvate dehydrogenase | BAB34380, AAC73226, NP_415392 | 1.2.4.1 | Over-express | increase Acetyl-CoA production |
| pflB | formate acetyltransferase (pyruvate formate lyase) | AAC73989, P09373 | EC: 2.3.1.54 | Delete or reduce | increase Acetyl-CoA production |
| plsB | acyltransferase | AAC77011 | 2.3.1.15 | D311E mutation | reduce limits on Acyl-CoA pool | E. coli K12 |
| poxB | pyruvate oxidase | AAC73958, NP_415392 | 1.2.2.2 | Delete or reduce | increase Acetyl-CoA production |
| pta | phosphotransacetylase | AAC75357, NP_416800 | 2.3.1.8 | Delete or reduce | increase Acetyl-CoA production |
| udhA | pyridine nucleotide transhydrogenase | CAA46822 | 1.6.1.1 | Over-express | conversion NADH to NADPH or vice versa |
| fadB | fused 3-hydroxybutyryl-CoA epimerase/delta(3)-cis-delta(2)-trans-enoyl-CoA isomerase/enoyl-CoA hydratase and 3-hydroxyacyl-CoA dehydrogenase | AP_003956 | 4.2.1.17, 5.1.2.3, 5.3.3.8, 1.1.1.35 | Delete or reduce | Block fatty acid degradation | E. coli |
| fadJ | 3-hydroxyacyl-CoA dehydrogenase; K01692 enoyl-CoA hydratase; K01782 3-hydroxybutyryl-CoA epimerase | AAC75401 | 1.1.1.35, 4.2.1.17, 5.1.2.3 | Delete or reduce | Block fatty acid degradation | E. coli |
| fadA | 3-ketoacyl-CoA thiolase | BAE77458 | 2.3.1.16 | Delete or reduce | Block fatty acid degradation | E. coli |
| fadI | beta-ketoacyl-CoA thiolase | AAC75402 | 2.3.1.16 | Delete or reduce | Block fatty acid degradation | E. coli |
| YdiO | acyl-coA dehydrogenase | YP_852786 | 1.3.99.- | Delete or reduce | Block fatty acid degradation | E. coli |

FIG. 9E

| 2. Structure Control | | | | | | |
|---|---|---|---|---|---|---|
| 2A. Chain Length Control | | | | | | |
| 2 | tesA | thioesterase | P0ADA1 | 3.1.2.-; 3.1.1.5 | Delete and/or express | C18 Chain Length |
| | tesA without leader sequence | thioesterase | AAC73596, NP_415027 | 3.1.2.-; 3.1.1.5 | express or overexpress | C18:1 | E.coli |
| | tesA without leader sequence:L109P | thioesterase | P0ADA1 | 3.1.2.-; 3.1.1.5 | Express and/or overexpress mutation L109P | <C18 Chain Length | E. coli |
| | fatB1 (umbellularia) | thioesterase | Q41635 | 3.1.2.14 | express or overexpress | C12:0 | Umbellularia californica |
| | fatB2 (umbellularia)DELETE umbelluria) | thioesterase | AAC49269 | 3.1.2.14 | express or overexpress | C8:0 - C10:0 | Cuphea hookeriana |
| | fatB3 | thioesterase | AAC72881 | 3.1.2.14 | express or overexpress | C14:0 - C16:0 | Cuphea hookeriana |
| | fatB (cinnamonum) | thioesterase | Q39473 | 3.1.2.14 | express or overexpress | C14:0 | Cinnamomum camphora |
| | fatB[M141T]* | thioesterase | CAA85388 | 3.1.2.14 | express or overexpress | C16:1 | Arabidopsis thaliana |
| | fatA1 (Helianthus) | thioesterase | AAL79361 | 3.1.2.14 | express or overexpress | C18:1 | Helianthus annuus |
| | atfata (ARABIDOPSIS FATA ACYL-ACP THIOESTERASE) | thioesterase | NP_189147, NP_193041 | 3.1.2.14 | express or overexpress | C18:1 | Arabidopsis thaliana |
| | fatA | thioesterase | CAC39106 | 3.1.2.14 | express or overexpress | C18:1 | Brassica juncea |

FIG. 9F

| | fatA (cuphea) | thioesterase | AAC72883 | 3.1.2.14 | express or overexpress | | C18:1 | Cuphea hookeriana |
|---|---|---|---|---|---|---|---|---|
| | | attenuate FabH | | | | | | |
| | | express FabH from S. glaucescens or S. coelicolor and knock out endogenouse FabH | | | | | | |
| | | express FabH from B. subtilis and knock out endogenouse FabH | | | | | increase branched chain fatty acid derivatives | |
| 2B. Branching Control | | | | | | | | |
| | | bdk - E3 - dihydrolipoyl dehyrodgenase subunit | | | EC 1.2.4.4 | | | |
| | | bkd - E1 - alpha/beta subunit | decarboxylase subunits of branched-chain α-keto acid dehydrogenase complex | | EC 1.2.4.4 | | | |
| | | bkd - E2 - dihydrolipoyl transacylase subunit | | | EC 1.2.4.4 | | | |
| | | bkdA1 | branched-chain α-keto acid dehydrogenase a-subunit (E1a) | NP_628006 | EC 1.2.4.4 | express or Over-Express | make branched-chain acyl-CoA precursors | Streptomyces coelicolor |

FIG. 9G

| | | | | | |
|---|---|---|---|---|---|
| bkdB1 | branched-chain α-keto acid dehydrogenase a-subunit (E1b) | NP_628005 | EC 1.2.4.4 | express or Over-Express | make branched-chain acyl-CoA precursors | Streptomyces coelicolor |
| bkdC1 | dihydrolipoyl transacetylase (E2) | NP_628004 | EC 2.3.1.168 | express or Over-Express | make branched-chain acyl-CoA precursors | Streptomyces coelicolor |
| bkdA2 | branched-chain a-ketoacid dehydrogenase a-subunit (E1a) | NP_733618 | EC 1.2.4.4 | express or Over-Express | make branched-chain acyl-CoA precursors | Streptomyces coelicolor |
| bkdB2 | branched-chain a-ketoacid dehydrogenase b-subunit (E1b) | NP_628019 | EC 1.2.4.4 | express or Over-Express | make branched-chain acyl-CoA precursors | Streptomyces coelicolor |
| bkdC2 | dihydrolipoyl transacetylase (E2) | NP_628018 | EC 2.3.1.168 | express or Over-Express | make branched-chain acyl-CoA precursors | Streptomyces coelicolor |
| bkdA | branched-chain a-ketoacid dehydrogenase a-subunit (E1a) | BAC72074 | EC 1.2.4.4 | express or Over-Express | make branched-chain acyl-CoA precursors | Streptomyces avermitilis |
| bkdB | branched-chain a-ketoacid dehydrogenase b-subunit (E1b) | BAC72075 | EC 1.2.4.4 | express or Over-Express | make branched-chain acyl-CoA precursors | Streptomyces avermitilis |
| bkdC | dihydrolipoyl transacetylase (E2) | BAC72076 | EC 2.3.1.168 | express or Over-Express | make branched-chain acyl-CoA precursors | Streptomyces avermitilis |
| bkdF | branched-chain a-ketoacid dehydrogenase a-subunit (E1a) | BAC72088 | EC 1.2.4.4 | express or Over-Express | make branched-chain acyl-CoA precursors | Streptomyces avermitilis |
| bkdG | branched-chain a-ketoacid dehydrogenase b-subunit (E1b) | BAC72089 | EC 1.2.4.4 | express or Over-Express | make branched-chain acyl-CoA precursors | Streptomyces avermitilis |

FIG. 9H

| | | | | | | |
|---|---|---|---|---|---|---|
| bkdH | dihydrolipoyl transacetylase (E2) | BAC72090 | EC 2.3.1.168 | express or Over-Express | make branched-chain acyl-CoA precursors | Streptomyces avermitilis |
| bkdAA | branched-chain a-ketoacid dehydrogenase a-subunit (E1a) | NP_390285 | EC 1.2.4.4 | express or Over-Express | make branched-chain acyl-CoA precursors | Bacillus subtilis |
| bkdAB | branched-chain a-ketoacid dehydrogenase b-subunit (E1b) | NP_390284 | EC 1.2.4.4 | express or Over-Express | make branched-chain acyl-CoA precursors | Bacillus subtilis |
| bkdB | dihydrolipoyl transacetylase (E2) | NP_390283 | EC 2.3.1.168 | express or Over-Express | make branched-chain acyl-CoA precursors | Bacillus subtilis |
| bkdA1 | branched-chain a-ketoacid dehydrogenase a-subunit (E1a) | AAA65614 | EC 1.2.4.4 | express or Over-Express | make branched-chain acyl-CoA precursors | Pseudomonas putida |
| bkdA2 | branched-chain a-ketoacid dehydrogenase b-subunit (E1b) | AAA65615 | EC 1.2.4.4 | express or Over-Express | make branched-chain acyl-CoA precursors | Pseudomonas putida |
| bkdC | dihydrolipoyl transacetylase (E2) | AAA65617 | EC 2.3.1.168 | express or Over-Express | make branched-chain acyl-CoA precursors | Pseudomonas putida |
| lpd | dihydrolipoamide dehydrogenase (E3) | NP_414658 | 1.8.1.4 | express or Over-Express | make branched-chain acyl-CoA precursors | Escherichia coli |
| ilvE | branched-chain amino acid aminotransferase | YP_026247 | 2.6.1.42 | express or Over-Express | make branched a-ketoacids | Escherichia coli |
| ilvE | branched-chain amino acid aminotransferase | AAF34406 | 2.6.1.42 | express or Over-Express | make branched a-ketoacids | Lactococcus lactis |
| ilvE | branched-chain amino acid aminotransferase | NP_745648 | 2.6.1.42 | express or Over-Express | make branched a-ketoacids | Pseudomonas putida |
| ilvE | branched-chain amino acid aminotransferase | NP_629657 | 2.6.1.42 | express or Over-Express | make branched a-ketoacids | Streptomyces coelicolor |

FIG. 9I

| | | | | | |
|---|---|---|---|---|---|
| ccr | crotonyl-CoA reductase | NP_630556 | 1.6.5.5,1.1.1.1 | express or Over-Express | Converting crotonyl-CoA to butyryl-CoA | *Streptomyces coelicolor* |
| ccr | crotonyl-CoA reductase | AAD53915 | 1.6.5.5,1.1.1.1 | express or Over-Express | Converting crotonyl-CoA to butyryl-CoA | *Streptomyces cinnamonensis* |
| IcmA, isobutyryl-CoA mutase | isobutyryl-CoA mutase, subunit A | NP_629554 | 5.4.99.2 | express or Over-Express | converting butyryl-CoA to isobutyryl-CoA | *Streptomyces coelicolor* |
| IcmA, isobutyryl-CoA mutase | isobutyryl-CoA mutase, subunit A | AAC08713 | 5.4.99.2 | express or Over-Express | converting butyryl-CoA to isobutyryl-CoA | *Streptomyces cinnamonensis* |
| IcmB, isobutyryl-CoA mutase | isobutyryl-CoA mutase, subunit B | NP_630904 | 5.4.99.2 | express or Over-Express | converting butyryl-CoA to isobutyryl-CoA | *Streptomyces coelicolor* |
| IcmB, isobutyryl-CoA mutase | isobutyryl-CoA mutase, subunit B | CAB59633 | 5.4.99.2 | express or Over-Express | converting butyryl-CoA to isobutyryl-CoA | *Streptomyces cinnamonensis* |
| FabH, ACPs and fabF genes with specificity for branched chain acyl-CoAs | | | | | | |
| IlvE | branched-chain amino acid aminotransferase | CAC12788 | EC2.6.1.42 | over express | branched chain amino acid amino transferase | Staphylococcus carnosus |
| FabH1 | beta-ketoacyl-ACP synthase III | NP_626634 | 2.3.1.180 | express or Over-Express | initiation of branched-chain fatty acid biosynthesis | *Streptomyces coelicolor* |

FIG. 9J

| | | | | | |
|---|---|---|---|---|---|
| ACP | acyl-carrier protein | NP_626635 | NONE | express or Over-Express | initiation and elongation of branched-chain fatty acid biosynthesis | Streptomyces coelicolor |
| FabF | beta-ketoacyl-ACP synthase II | NP_626636 | 2.3.1.179 | express or Over-Express | elongation of branched-chain fatty acid biosynthesis | Streptomyces coelicolor |
| FabH3 | beta-ketoacyl-ACP synthase III | NP_823466 | 2.3.1.180 | express or Over-Express | initiation of branched-chain fatty acid biosynthesis | Streptomyces coelicolor |
| FabC3 (ACP) | acyl-carrier protein | NP_823467 | NONE | express or Over-Express | initiation and elongation of branched-chain fatty acid biosynthesis | Streptomyces avermitilis |
| FabF | beta-ketoacyl-ACP synthase II | NP_823468 | 2.3.1.179 | express or Over-Express | elongation of branched-chain fatty acid biosynthesis | Streptomyces avermitilis |
| FabH_A | beta-ketoacyl-ACP synthase III | NP_389015 | 2.3.1.180 | express or Over-Express | initiation of branched-chain fatty acid biosynthesis | Streptomyces avermitilis |
| FabH_B | beta-ketoacyl-ACP synthase III | NP_388898 | 2.3.1.180 | express or Over-Express | initiation of branched-chain fatty acid biosynthesis | Bacillus subtilis |
| ACP | acyl-carrier protein | NP_389474 | NONE | express or Over-Express | initiation and elongation of branched-chain fatty acid biosynthesis | Bacillus subtilis |

FIG. 9K

| | | | | | |
|---|---|---|---|---|---|
| FabF | beta-ketoacyl-ACP synthase II | NP_389016 | 2.3.1.179 | express or Over-Express | elongation of branched-chain fatty acid biosynthesis | Bacillus subtillis |
| SmalDRAFT_08 18 | beta-ketoacyl-ACP synthase III | ZP_01643059 | 2.3.1.180 | express or Over-Express | initiation of branched-chain fatty acid biosynthesis | Stenotrophomonas maltophilia |
| SmalDRAFT_08 21 | acyl-carrier protein | ZP_01643063 | NONE | express or Over-Express | initiation and elongation of branched-chain fatty acid biosynthesis | Stenotrophomonas maltophilia |
| SmalDRAFT_08 22 | beta-ketoacyl-ACP synthase II | ZP_01643064 | 2.3.1.179 | express or Over-Express | elongation of branched-chain fatty acid biosynthesis | Stenotrophomonas maltophilia |
| FabH | beta-ketoacyl-ACP synthase III | YP_123672 | 2.3.1.180 | express or Over-Express | initiation of branched-chain fatty acid biosynthesis | Legionella pneumophila |
| ACP | acyl-carrier protein | YP_123675 | NONE | express or Over-Express | initiation and elongation of branched-chain fatty acid biosynthesis | Legionella pneumophila |
| FabF | beta-ketoacyl-ACP synthase II | YP_123676 | 2.3.1.179 | express or Over-Express | elongation of branched-chain fatty acid biosynthesis | Legionella pneumophila |
| FabH | beta-ketoacyl-ACP synthase III | NP_415609 | 2.3.1.180 | delete or reduce | initiation of branched-chain fatty acid biosynthesis | Escherichia coli |

FIG. 9L

| | FabF | beta-ketoacyl-ACP synthase II | NP_415613 | 2.3.1.179 | delete or reduce | elongation of branched-chain fatty acid biosynthesis | Escherichia coli |
|---|---|---|---|---|---|---|---|
| To Produce Cyclic Fatty Acids | | | | | | | |
| | AnsJ | dehydratase (putative) | not available | not available | express or Over-Express | cyclohexylcarbonyl-CoA boiosynthesis | Streptomyces collinus |
| | AnsK | CoA ligase (putative) | not available | not available | express or Over-Express | cyclohexylcarbonyl-CoA boiosynthesis | Streptomyces collinus |
| | AnsL | dehydrogenase (putative) | not available | not available | express or Over-Express | cyclohexylcarbonyl-CoA boiosynthesis | Streptomyces collinus |
| | ChcA | enoyl-CoA reductase | U72144 | EC 1.3.1.34 | express or Over-Express | cyclohexylcarbonyl-CoA boiosynthesis | Streptomyces collinus |
| | AnsM | oxidorecutase (putative) | not available | not available | express or Over-Express | cyclohexylcarbonyl-CoA boiosynthesis | Streptomyces collinus |
| | PlmJ | dehydratase (putative) | AAQ84158 | not available | express or Over-Express | cyclohexylcarbonyl-CoA boiosynthesis | Streptomyces sp. HK803 |
| | PlmK | CoA ligase (putative) | AAQ84158 | not available | express or Over-Express | cyclohexylcarbonyl-CoA boiosynthesis | Streptomyces sp. HK803 |
| | PlmL | dehydrogenase (putative) | AAQ84159 | not available | express or Over-Express | cyclohexylcarbonyl-CoA boiosynthesis | Streptomyces sp. HK803 |
| | ChcA | enoyl-CoA reductase | AAQ84160 | EC 1.3.1.34 | express or Over-Express | cyclohexylcarbonyl-CoA boiosynthesis | Streptomyces sp. HK803 |
| | PlmM | oxidorecutase (putative) | AAQ84161 | not available | express or Over-Express | cyclohexylcarbonyl-CoA boiosynthesis | Streptomyces sp. HK803 |

FIG. 9M

| | | | | | | | |
|---|---|---|---|---|---|---|---|
| | ChcB | enoyl-CoA isomerase | AF268489 | not available | express or Over-Express | cyclohexylcarbonyl-CoA boiosynthesis | Streptomyces collinus |
| | ChcB/CaiD | enoyl-CoA isomerase | NP_629292 | 4.2.1.- | express or Over-Express | cyclohexylcarbonyl-CoA boiosynthesis | Streptomyces coelicolor |
| | ChcB/CaiD | enoyl-CoA isomerase | NP_824296 | 4.2.1.- | express or Over-Express | cyclohexylcarbonyl-CoA boiosynthesis | Streptomyces avermitilis |
| 2C. Saturation Level Control | | | | | | | |
| | Sfa | Suppressor of FabA | AAN79592, AAC44390 | NONE | Over-express | increase monounsaturated fatty acids | E.coli |
| | also see FabA in sec. 1 | | | | express | produce unsaturated fatty acids | |
| | GnsA | suppressors of the secG null mutation | ABD18647.1 | NONE | Over-express | increase unsaturated fatty acid esters | E.coli |
| | GnsB | suppressors of the secG null mutation | AAC74076.1 | NONE | Over-express | increase unsaturated fatty acid esters | E.coli |
| | also see section 2A - items with :0 are unsaturated (no double bonds) and with :1 are saturated (1 double bond) | | | | | | |
| | fabB | 3-oxoacyl-[acyl-carrier-protein] synthase I | BAA16180 | EC:2.3.1.41 | overexpress | modulate unsaturated fatty acid production | Escherichia coli |

FIG. 9N

| | | | | | | |
|---|---|---|---|---|---|---|
| fabK | trans-2-enoyl-ACP reductase II | AAF98273 | 1.3.1.9 | express | modulate unsaturated fatty acid production | Streptococcus pneumonia |
| fabL | enoyl-(acyl carrier protein) reductase | AAU39821 | 1.3.1.9 | express | modulate unsaturated fatty acid production | Bacillus licheniformis DSM 13 |
| fabM | trans-2, cis-3-decenoyl-ACP isomerase | DAA05501 | 4.2.1.17 | Over-express | modulate unsaturated fatty acid production | Streptococcus mutans |

Fatty Aldehyde Output

| | | | | | | |
|---|---|---|---|---|---|---|
| thioesterase | see chain length control section | | | | | |

Export

| | | | | | | |
|---|---|---|---|---|---|---|
| Wax ester exporter (FATP family, Fatty Acid (long chain) Transport Protein) | | NP_524723 | NONE | express | export wax | Drosophila melanogaster |
| ABC transport protein | putative alkane transporter | AAN73268 | NONE | express | export products | Rhodococcus erythropolis |
| CER5 | wax transporter | At1g51500, AY734542, At3g21090, At1g51460 | NONE | express | export products | Arabidopsis thaliana |
| AtMRP5 | Arabidopsis thaliana multidrug resistance-associated | NP_171908 | NONE | express | export products | Arabidopsis thaliana |
| AmiS2 | ABC transporter AmiS2 | JC5491 | | express | export products | Rhodococcus sp. |

FIG. 9O

| | | | | | | | |
|---|---|---|---|---|---|---|---|
| | AtPGP1 | ARABIDOPSIS THALIANA P GLYCOPROTEIN1 | NP_181228 | NONE | express | export products | *Arabidopsis thaliana* |
| | AcrA | putative multidrug-efflux transport protein acrA | CAF23274 | NONE | express | export products | *Candidatus Protochlamydia amoebophila UWE25* |
| | AcrB | probable multidrug-efflux transport protein, acrB | CAF23275 | NONE | express | export products | *Candidatus Protochlamydia amoebophila UWE25* |
| | TolC | Outer membrane protein [Cell envelope biogenesis, | ABD59001 | NONE | express | export products | *Francisella tularensis subsp. novicida* |
| | AcrE | transmembrane protein affects septum formation and cell membrane permeability | YP_312213 | NONE | express | export products | *Shigella sonnei Ss046* |
| | AcrF | Acriflavine resistance protein F | P24181 | NONE | express | export products | *Escherichia coli* |
| | tll1618 | multidrug efflux transporter | NP_682408.1 | NONE | express | export products | *Thermosynechococcus elongatus BP-1]* |
| | tll1619 | multidrug efflux transporter | NP_682409.1 | NONE | express | export products | *Thermosynechococcus elongatus BP-1]* |
| | tll0139 | multidrug efflux transporter | NP_680930.1 | NONE | express | export products | *Thermosynechococcus elongatus BP-1]* |
| | | | | | | | |
| 5. Fermentation | | | | | | | |
| | replication checkpoint genes | | | | | increase output efficiency | |

FIG. 9P

| | | | | | |
|---|---|---|---|---|---|
| umuD | DNA polymerase V, subunit | YP_310132 | 3.4.21.- | Over-express | increase output efficiency | Shigella sonnei Ss046 |
| umuC | DNA polymerase V, subunit | ABC42261 | 2.7.7.7 | Over-express | increase output efficiency | Escherichia coli |
| NADH:NADPH transhydrogenase (alpha and beta subunits) (pntA, pntB) | | P07001, P0AB70 | 1.6.1.2 | express | increase output efficiency | Shigella flexneri |

FIG. 10A

| | Annotations | Pfam | Accession # |
|---|---|---|---|
| Zn-dep. Alcohol Dehydrogenases | | | |
| YjgB | best homolog of *Acinetobacter* alrA (50%) | 00107, 08240 | NP_418690 |
| YahK | best homolog of yjgB (31%) | 00107, 08240 | NP_414859 |
| AdhP | active on ethanol, more efficient as aldehyde reductase | 00107, 08240 | NP_415995 |
| YdjL | predicted oxidoreductase, Zn-dependent and NAD(P)-binding | 00107, 08240 | NP_416290 |
| YdjJ | predicted oxidoreductase, Zn-dependent and NAD(P)-binding | 00107, 08240 | NP_416288 |
| YjgV (idnD) | oxidizes L-idonate using NAD and reduces of 5-ketogluconate using NADH or NADPH | 00107, 08240 | NP_418688 |
| Tdh | converts threonine and NAD to 1,2-amino-3-oxobutanoate and NADH | 00107, 08240 | NP_418073 |
| YjjN | possible L-galactonate oxidoreductase | 00107, 08240 | NP_418778 |
| RspB | predicted oxidoreductase, Zn-dependent and NAD(P)-binding, unknown substrate | 00107, 08240 | NP_416097 |
| GatD | galactitol-1-phosphate dehydrogenase, Zn-dependent and NAD(P)-binding | 00107, 08240 | NP_416594 |
| YphC | predicted oxidoreductase, Zn-dependent and NAD(P)-binding | 00107, 08240 | NP_417040 |
| YhdH | predicted oxidoreductase, Zn-dependent and NAD(P)-binding (3D) | 00107, 08240 | NP_417719 |
| YcjQ | predicted oxidoreductase, Zn-dependent and NAD(P)-binding, large operon | 00107 | NP_415829 |
| YncB | predicted oxidoreductase, Zn-dependent and NAD(P)-binding | 00107 | NP_415966 |
| Qor | NADPH:quinone reductase and related Zn-dependent oxidoreductases | 00107, 08240 | NP_418475 |
| Adh3 (frmA) | alcohol dehydrogenase class III/glutathione-dependent formaldehyde dehydrogenase | 00107, 08240 | NP_414890 |
| YbdR | predicted oxidoreductase, Zn-dependent and NAD(P)-binding | 00107, 08240 | NP_415141 |
| YggP | predicted oxidoreductase, Zn-dependent and NAD(P)-binding | 00107, 08240 | YP_026187 |
| Fe-dep. Alcohol Dehydrogenases | | | |
| YiaY | unknown funtion, operon with aldB (aldehyde dehydrogenase) | 00465 | YP_026233 |
| FucO | glyceroaldehyde to ethylene glycole or lactaldehyde to 1,3-propanediol | 00465 | NP_417279 |
| EutG | ethanolamine utilization? | 00465 | NP_416948 |
| YqhD | reduces butanal, response mechanism to lipid peroxygenation? (3D) | 00465 | NP_417484 |
| AdhE | three Fe++-dependent catalytic functions: alcohol dh, acetaldehyde dh and pyruvate formate-lyase deactivase, poorly active with pentanol | 00465 | NP_415757 |
| Aldo-Keto Reductases | | | |
| yafB (dkgB) | reduces methylglyoxal, 2,5-diketogluconate and 4-nitrobenzaldehyde | 00248 | NP_414743 |
| YdjG | reduces methy glyoxal, NADH specific | 00248 | NP_416285 |
| YeaE | reduces methy glyoxal | 00248 | NP_416295 |
| YqhE (dkgA) | reduces methy glyoxal and 2,5-diketogluconate | 00248 | NP_417485 |
| YajO | putative NAD(P)H-dependent xylose reductase | 00248 | NP_414953 |
| YghZ | reduces methy glyoxal | 00248 | NP_417474 |
| Tas | Multicopy expression suppresses prephenate dehydrogenase defect | 00248 | NP_417311 |
| YdhF | predicted oxidoreductase | 00248 | YP_025305 |
| YdbC | predicted oxidoreductase | 00248 | NP_415924 |
| Short-Chain Dehydrogenases | | | |
| ybbO | short chain dehydrogenase | pfam00106 | NP_415026 |
| yohF | predicted oxidoreductase with NAD(P)-binding Rossmann-fold domain | pfam00106 | NP_416641 |
| YciK | short chain dehydrogenase | pfam00106 | NP_415787 |
| YgfF | predicted NAD(P)-binding oxidoreductase with NAD(P)-binding Rossmann-fold domain | pfam00106 | NP_417378 |
| YghA | oxidoreductase | pfam00106 | NP_417476 |
| YjgI | predicted oxidoreductase with NAD(P)-binding Rossmann-fold domain | pfam00106 | NP_418670 |
| YdfG | putative oxidoreductase, L-allo-threonine dehydrogenase, NAD(P)-binding | pfam00106 | NP_416057 |
| YgcW | putative oxidoreductase, predicted deoxygluconate dehydrogenase | pfam00106 | NP_417254 |
| UcpA | predicted acetoin dehydrogenase (diacetyl reductase) | pfam00106 | NP_416921 |
| EntA | 2,3-Dihydro-2,3-dihydroxybenzoate dehydrogenase | pfam00106 | NP_415128 |
| FolM | dihydrofolate reductase, THF biosynthesis | pfam00106 | NP_416123 |
| HdhA | 7-alpha-hydroxysteroid dehydrogenase | pfam00106 | NP_416136 |
| HcaB | 2,3-dihydroxy-2,3-dihydrophenylpropionate dehydrogenase, (aromatization) | pfam00106 | NP_417036 |
| SrlD | sorbitol-6-phosphate 2-dehydrogenase, glucitol-6-phosphate dehydrogenase | pfam00106 | NP_417185 |
| KduD | 2-deoxy-D-gluconate 3-dehydrogenase | pfam00106 | NP_417319 |
| IdnO | gluconate 5-dehydrogenase, 5-keto-D-gluconate 5-reductase | pfam00106 | NP_418687 |
| FabG | 3-oxoacyl-[acyl-carrier-protein] reductase | pfam00106 | NP_415611 |
| FabI | enoyl-[acyl carrier protein] reductase | pfam00106 | NP_415804 |
| YdjA | predicted oxidoreductase (FAD dep.) | pfam00881 | NP_416279 |

FIG. 10B ygjB (NP_418690)

Nucleotide sequence (SEQ ID NO:93)
```
   1 atgtcgatga taaaaagcta tgccgcaaaa gaagcgggcg gcgaactgga agtttatgag
  61 tacgatcccg gtgagctgag gccacaagat gttgaagtgc aggtggatta ctgcgggatc
 121 tgccattccg atctgtcgat gatcgataac gaatggggat tttcacaata tccgctggtt
 181 gccgggcatg aggtgattgg gcgcgtggtg gcactcggga gcgccgcgca ggataaaggt
 241 ttgcaggtcg gtcagcgtgt cgggattggc tggacggcgc gtagctgtgg tcactgcgac
 301 gcctgtatta gcggtaatca gatcaactgc gagcaaggtg cggtgccgac gattatgaat
 361 cgcggtggct ttgccgagaa gttgcgtgcg gactggcaat gggtgattcc actgccagaa
 421 aatattgata tcgagtccgc cgggccgctg ttgtgcggcg gtatcacggt ctttaaacca
 481 ctgttgatgc accatatcac tgctaccagc cgcgttgggg taattggtat tggcgggctg
 541 gggcatatcg ctataaaact tctgcacgca atgggatgcg aggtgacagc ctttagttct
 601 aatccggcga aagagcagga agtgctggcg atgggtgccg ataaagtggt gaatagccgc
 661 gatccgcagg cactgaaagc actggcgggg cagtttgatc tcattatcaa caccgtcaac
 721 gtcagcctcg actggcagcc ctattttgag tcgctgacct atggcggtaa tttccatacg
 781 gtcggtgcgg ttctcacgcc gctgtctgtt ccggccttta cgttaattgc gggcgatcgc
 841 agcgtctctg gttctgctac cggcacgcct tatgagctgc gtaagctgat gcgttttgcc
 901 gcccgcagca aggttgcgcc gaccaccgaa ctgttcccga tgtcgaaaat taacgacgcc
 961 atccagcatg tgcgcgacgg taaggcgcgt taccgcgtgg tgttgaaagc cgattttga
```

Amino acid sequence (SEQ ID NO:94)
```
   1 msmiksyaak eaggelevye ydpgelrpqd vevqvdycgi chsdlsmidn ewgfsqyplv
  61 aghevigrvv algsaaqdkg lqvgqrvgig wtarscghcd acisgnqinc eqgavptimn
 121 rggfaeklra dwqwviplpe nidiesagpl lcggitvfkp llmhhitats rvgvigiggl
 181 ghiaikllha mgcevtafss npakeqevla mgadkvvnsr dpqalkalag qfdliintvn
 241 vsldwqpyfe altyggnfht vgavltplsv paftliagdr svsgsatgtp yelrklmrfa
 301 arskvaptte lfpmskinda iqhvrdgkar yrvvlkadf
``` yahK (NP_414859)

Nucleotide sequence (SEQ ID NO:95)
```
   1 atgaagatca agctgttggt gcatattcc gctaaacaac cacttgaacc gatggatatc
  61 acccggcgtg aaccgggacc gaatgatgtc aaaatcgaaa tcgcttactg tggcgtttgc
 121 cattccgatc tccaccaggt ccgttccgag tgggcgggga cggtttaccc ctgcgtgccg
 181 ggtcatgaaa ttgtggggcg tgtggtagcc gttggtgatc aggtagaaaa atatgcgccg
 241 ggcgatctgg tcggtgtcgg ctgcattgtc gacagttgta acattgcga agagtgtgaa
 301 gacgggttgg aaaactactg tgatcacatg accggcacct ataactcgcc gacgccggac
 361 gaaccgggcc atactctggg cggctactca acagatcg tcgttcatga gcgatatgtt
 421 ctgcgtattc gtcacccgca gagcagctg gcggcggtgg ctcctttgtt gtgtgcaggg
 481 atcaccacgt attcgccgct acgtcactgg caggccgggc cgggtaaaaa agtgggcgtg
 541 gtcggcatcg gcggtctggg acatatgggg attaagctgg cccacgcgat gggggcacat
 601 gtggtggcat ttaccacttc tgaggcaaaa cgcgaagcgg caaaagccct ggggccgat
 661 gaagttgtta actcacgcaa tgccgatgag atggcggctc atctgaagag tttcgatttc
 721 attttgaata cagtagctgc gccacataat ctcgacgatt ttaccacctt gctgaagcgt
 781 gatggcacca tgacgctggt tggtgcgcct gcgacaccgc ataaatcgcc ggaagttttc
 841 aacctgatca tgaaacgccg tgcgatagcc ggttctatga ttggcggcat tccagaaact
 901 caggagatgc tcgatttttg cgccgaacat ggcatcgtgg ctgatataga gatgattcgg
 961 gccgatcaaa ttaatgaagc ctatgagcga atgctgcgcg tgatgtgaa atatcgtttt
1021 gttatcgata tcgcacact aacagactga
```

Amino acid sequence (SEQ ID NO:96)
```
   1 mkikavgays akqplepmdi trrepgpndv kieiaycgvc hsdlhqvrse wagtvypcvp
  61 gheivgrvva vgdqvekyap gdlvgvgciv dsckhceece dglenycdhm tgtynsptpd
 121 epghtlggys qqivvheryv lrirhpqeql aavapllcag ittysplrhw qagpgkkvgv
 181 vgigglghmg iklahamgah vvafttseak reaakalgad evvnsrnade maahlksfdf
 241 ilntvaaphn lddfttllkr dgtmtlvgap atphkspevf nlimkrraia gsmiggipet
```

FIG. 10C

```
301 qemldfcaeh givadiemir adqineayer mlrgdvkyrf vidnrtltd
``` adhP (NP_415995)

Nucleotide sequence (SEQ ID NO:97)

```
  1 atgaaggctg cagttgttac gaaggatcat catgttgacg ttacgtataa aacactgcgc
 61 tcactgaaac atggcgaagc cctgctgaaa atggagtgtt gtggtgtatg tcataccgat
121 cttcatgtta agaatggcga ttttggtgac aaaaccggcg taattctggg ccatgaaggc
181 atcggtgtgg tggcagaagt gggtccaggt gtcacctcat taaaaccagg cgatcgtgcc
241 agcgtggcgt ggttctacga aggatgcggt cattgcgaat actgtaacag tggtaacgaa
301 acgctctgcc gttcagttaa aaatgccgga tacagcgttg atggcgggat ggcggaagag
361 tgcatcgtgg tcgccgatta cgcggtaaaa gtgccagatg gtctggactc ggcggcggcc
421 agcagcatta cctgtgcggg agtcaccacc tacaaagccg ttaagctgtc aaaaattcgt
481 ccagggcagt ggattgctat ctacggtctt ggcggtctgg taacctcgc cctgcaatac
541 gcgaagaatg tctttaacgc caaagtgatc gccattgatg tcaatgatga gcagttaaaa
601 ctggcaaccg aaatgggcgc agatttagcg attaactcac acaccgaaga cgccgccaaa
661 attgtgcagg agaaaactgg tggcgctcac gctgcggtgg taacagcggt agctaaagct
721 gcgtttaact cggcagttga tgctgtccgt gcaggcggtc gtgttgtggc tgtcggtcta
781 ccgccggagt ctatgagcct ggatatccca cgtcttgtgc tggatggtat tgaagtggtc
841 ggttcgctgg tcggcacgcg ccaggattta actgaagcct ccagtttgc cgccgaaggt
901 aaagtggtgc cgaaagtcgc cctgcgtccg ttagcggaca tcaacaccat ctttactgag
961 atggaagaag gcaaaatccg tggccgcatg gtgattgatt ccgtcacta a
```

Amino acid sequence (SEQ ID NO:98)

```
  1 mkaavvtkdh hvdvtyktlr slkhgeallk meccgvchtd lhvkngdfgd ktgvilgheg
 61 igvvaevgpg vtslkpgdra svawfyegcg hceycnsgne tlcrsvknag ysvdggmaee
121 civvadyavk vpdglgdsaaa ssitcagvtt ykavklskir pgqwiaiygl gglgnlalqy
181 aknvfnakvi aidvndeqlk latemgadla inshtedaak ivqektggah aavvtavaka
241 afnsavdavr aggrvvavgl ppesmsldip rlvldgievv gslvgtrqdl teafqfaaeg
301 kvvpkvalrp ladintifte meegkirgrm vidfrh
``` ydjL (NP_416290)

Nucleotide sequence (SEQ ID NO:99)

```
   1 atgaaagcac tggctcggtt tggcaaggcc tttggcggct acaagatgat tgatgtccca
  61 caacccatgt gtggcccgga gatgtagtg attgaaatta agccgcggc aatctgcggc
 121 gcagacatga agcactacaa tgtcgatagc ggttctgatg agtttaactc tatccgcggc
 181 catgagttcg caggttgtat tgcgcaggtt ggtgaaaaag tcaaagactg gaaagtgggg
 241 caacgcgtcg tatcggataa cagcggtcac gtttgcggtg tttgtccggc ctgtgaacaa
 301 ggtgattttc tgtgttgtac agaaaaagta aaccttggtc tggataataa tacctggggc
 361 ggtggttttt ccaaatattg tctggttcct ggtgaaattc tcaaaattca tcgtcatgcg
 421 ttgtgggaaa tccctgatgg tgttgattat gaggacgcag ccgtacttga ccctatctgt
 481 aatgcctaca atccatcgc gcagcaatcg aaattccttc ctggtcagga tgtggtcgtc
 541 atcggcactg gcccactcgg gctgttctcc gtacaaatgg cgcgaattat gggggcggta
 601 aatatcgtcg tcgttggtct gcaagaagat gtggcggtcc gcttcccggt tgcaaaagaa
 661 ctgggtgcga cggcagtagt aaatggttct accgaagatg tggtggcgcg ctgccagcaa
 721 atttgtggca agacaatct gggactggtg attgaatgct ccggtgccaa tatcgcactg
 781 aaacaagcca tcgaaatgct ccgcccgaac ggggaagtgg tacgcgttgg aatgggcttc
 841 aaacctcttg atttctcgat taatgacatt accgcctgga caaaagcat cattgggcat
 901 atggcctatg actccacctc atggcgtaac gctatcaggc tattagccag cggcgctatc
 961 aaagtcaaac cgatgatcac gcatcgtatc ggcctgtcgc aatggcgcga agggtttgat
1021 gcgatggtcg ataaaaccgc aatcaaagtg atcatgactt acgactttga tgaataa
```

Amino acid sequence (SEQ ID NO:100)

```
  1 mkalarfgka fggykmidvp qpmcgpedvv ieikaaaicg admkhynvds gsdefnsirg
 61 hefagciaqv gekvkdwkvg qrvvsdnsgh vcgvcpaceq gdflcctekv nlgldnntwg
121 ggfskyclvp geilkihrha lweipdgvdy edaavldpic nayksiaqqs kflpgqdvvv
181 igtgplglfs vqmarimgav nivvvglqed vavrfpvake lgatavvngs tedvvarcqq
241 icgkdnlglv iecsganial kqaiemlrpn gevvrvgmgf kpldfsindi tawnksiigh
```

FIG. 10D

```
301 maydstswrn airllasgai kvkpmithri glsqwregfd amvdktaikv imtydfde
``` ydjJ (NP 416288)

Nucleotide sequence (SEQ ID NO:101)

```
   1 atgaaaaatt caaaagcaat attgcaggtg ccgggcacaa tgaaaattat ttcagcagaa
  61 ataccagtgc ctaaagaaga tgaagttttg attaaagtag aatatgtcgg tatttgtggt
 121 tcagatgtac atggttttga atcaggcccg tttattccgc ctaaagaccc aaatcaagaa
 181 attggcctgg gtcatgaatg cgccgggacg gttgtggctg tgggaagccg cgtgcgcaaa
 241 tttaaaccgg gggatcgggt aaatatcgaa cctggcgttc cttgcggtca ctgtcgttac
 301 tgtctggaag gcaaatataa catctgcccg gacgttgatt ttatggcgac acaacccaac
 361 taccgcggcg cattaacgca ctatctgtgt catccggaga gctttactta caaactgccc
 421 gacaatatgg acacgatgga aggggcgctg gtggagcctg ccgcagtcgg gatgcatgcc
 481 gcgatgctgg cagatgttaa accgggtaag aagataatta ttctgggagc aggttgtatt
 541 ggtttgatga cgttgcaagc gtgcaaatgc ctgggagcaa cggaaattgc cgtcgttgat
 601 gtgctggaaa acgtctggc aatggcggaa cagcttggtg cgacagtggt tattaacggc
 661 gcaaaagaag acactattgc acgctgtcag caatttaccg aagacatggg cgcagatatt
 721 gttttcgaaa cagcgggttc tgcggtcacc gttaaacagg cacctatct ggtaatgcgc
 781 ggcggtaaaa ttatgattgt tggtactgta cccggcgatt cggcaatcaa tttcctcaaa
 841 atcaatcgcg aagtcactat ccagacggta ttccgctatg ccaatcgtta tccggtcacg
 901 attgaagcta tttcttcagg gcgattcgat gtgaaatcga tggtgacgca tatttacgat
 961 tatcgggatg tacaacaggc atttgaagag tcagttaaca acaaacgcga cattattaaa
1021 ggcgttatta aaattagcga ttaa
```

Amino acid sequence (SEQ ID NO:102)

```
   1 mknskailqv pgtmkiisae ipvpkedevl ikveyvgicg sdvhgfesgp fippkdpnqe
  61 iglghecagt vvavgsrvrk fkpgdrvnie pgvpcghcry clegkynicp dvdfmatqpn
 121 yrgalthylc hpesftyklp dnmdtmegal vepaavgmha amladvkpgk kiiilgagci
 181 glmtlqackc lgateiavvd vlekrlamac qlgatvving akedtiarcq qftedmgadi
 241 vfetagsavt vkqapylvmr ggkimivgtv pgdsainflk inrevtiqtv fryanrypvt
 301 ieaissgrfd vksmvthiyd yrdvqqafee svnnkrdiik gvikisd
``` idnD (NP 418688)

Nucleotide sequence (SEQ ID NO:103)

```
   1 atgcaagtga aaacacagtc ctgcgttgtt gcgggcaaga aaactgttgc cgttaccgag
  61 cagacgatag attggaataa taatggaaca ttagtacaaa taacccgagg tggaatttgc
 121 ggttccgatt tacattatta tcaggaagga aaagtaggta atttcatgat aaaggcaccg
 181 atggtgttag gtcatgaagt tatcggtaaa gttattcata gcgactcatc agaattacat
 241 gaaggcaaa cggtagccat taatccgtct aaaccgtgcg gtcactgcaa atactgcatt
 301 gaacataacg agaatcagtg tacagatatg cgttttttg cagtgccat gtatttccct
 361 catgttgatg gtggttttac ccgttataaa atggtcgaaa cgtcgcaatg tgtcccttat
 421 ccggccaaag ctgacgaaaa ggttatggct tttgccgaac ctttagccgt cgcgattcat
 481 gccgcacatc aggccggtga gttacagggc aagcgagtat ttatttcggg tgttggaccc
 541 attggctgcc tgattgtcag tgcagtgaaa acactggggg ccgcggaaat tgtctgtgct
 601 gatgtgagtc cccgttccct ttcgctgggc aaagagatgg gggcggatgt gctcgtaaac
 661 ccacaaaacg acgacatgga tcactggaaa gcggaaaaag gctatttcga tgtcagcttt
 721 gaagtgtccg gtcatccttc atcagtgaat acctgtctgg aggtcactcg tgcacgcggc
 781 gtaatggtgc aggtaggtat gggaggcgcg atggcagaat cccaatgat gacgttgatt
 841 ggtaaggaga tttcactcag aggctctttc cgttttacca gcgaatttaa taccgcagtg
 901 tcatggctgg cgaatggcgt tatcaatcca ctgcctttac tgagtgctga atatccctc
 961 actgacctgg aagaggcgct acgtttcgcc ggtgataaaa cccaggcagc aaaagtccag
1021 cttgtttct aa
```

Amino acid sequence (SEQ ID NO:104)

```
   1 mqvktqscvv agkktvavte qtidwnnngt lvqitrggic gsdlhyyqeg kvgnfmikap
  61 mvlghevigk vihsdsselh egqtvainps kpcghckyci ehnenqctdm rffgsamyfp
 121 hvdggftryk mvetsqcvpy pakadekvma faeplavaih aahqagelqg krvfisgvgp
 181 igclivsavk tlgaaeivca dvsprslslg kemgadvlvn pqnddmdhwk aekgyfdvsf
 241 evsghpssvn tclevtrarg vmvqvgmgga maefpmmtli gkeislrgsf rftsefntav
```

FIG. 10E

```
301 swlangvinp lpllsaeypf tdleealrfa gdktqaakvq lvf
``` tdh (NP_418073)

Nucleotide sequence (SEQ ID NO:105)
```
   1 atgaaagcgt tatccaaact gaaagcggaa gagggcatct ggatgaccga cgttcctgta
  61 ccggaactcg gcataacga tctgctgatt aaaatccgta aaacagccat ctgcgggact
 121 gacgttcaca tctataactg ggatgagtgg tcgcaaaaaa ccatcccggt gccgatggtc
 181 gtgggccatg aatatgtcgg tgaagtggta ggtattggtc aggaagtgaa aggcttcaag
 241 atcggcgatc gcgtttctgg cgaaggccat atcacctgtg gtcattgccg caactgtcgt
 301 ggtggtcgta cccatttgtg ccgcaacacg ataggcgttg gtgttaatcg cccgggctgc
 361 tttgccgaat atctggtgat cccggcattc aacgccttca aatccccga caatatttcc
 421 gatgacttag ccgcaatttt tgatcccttc ggtaacgccg tgcataccgc gctgtcgttt
 481 gatctggtgg gcgaagatgt gctggtttct ggtgcaggcc cgattggtat tatggcagcg
 541 gcggtggcga aacacgttgg tgcacgcaat gtggtgatca ctgatgttaa cgaataccgc
 601 cttgagctgg cgcgtaaaat gggtatcacc cgtcggttta acgtcgccaa agaaaatctc
 661 aatgacgtga tggcggagtt aggcatgacc gaaggttttg atgtcggtct ggaaatgtcc
 721 ggtgcgccgc cagcgtttcg taccatgctt gacaccatga tcacggcgg ccgtattgcg
 781 atgctgggta ttccgccgtc tgatatgtct atcgactgga ccaaagtgat ctttaaaggc
 841 ttgttcatta aaggtattta cggtcgtgag atgtttgaaa cctggtacaa gatggcggcg
 901 ctgattcagt ctggcctcga tctttcgccg atcattaccc atcgtttctc tatcgatgat
 961 ttccagaagg gctttgacgc tatgcgttcg ggccagtccg ggaaagttat tctgagctgg
1021 gattaa
```

Amino acid sequence (SEQ ID NO:106)
```
   1 mkalsklkae egiwmtdvpv pelghndlli kirktaicgt dvhiynwdew sqktipvpmv
  61 vgheyvgevv gigqevkgfk igdrvsgegh itcghcrncr ggrthlcrnt igvgvnrpgc
 121 faeylvipaf nafkipdnis ddlaaifdpf gnavhtalsf dlvgedvlvs gagpigimaa
 181 avakhvgarn vvitdvneyr lelarkmgit ravnvakenl ndvmaelgmt egfdvglems
 241 gappafrtml dtmnhggria mlgippsdms idwtkvifkg lfikgiygre mfetwykmaa
 301 liqsgldlsp iithrfsidd fqkgfdamrs gqsgkvilsw d
``` yjjN (NP_418778)

Nucleotide sequence (SEQ ID NO:107)
```
   1 atgtctacga tgaatgtttt aatttgccag cagccgaaag aattagtctg aaacaacgc
  61 gagataccta ttccggggtga caatgaagca ttaataaaaa ttaagtctgt cgggatttgc
 121 ggtaccgata ttcatgcctg gggtggaaat caaccatttt ttagttatcc acgtgttta
 181 ggccatgaaa tatgtgggga gattgttggg ctgggtaaaa atattgctga tcttaaaaat
 241 ggtcagcaag ttgctgtgat cccttatgtt gcctgtcagc aatgcccggc gtgtaaagc
 301 gggcgtacca attgctgtga aaaaatttca gtcattggcg tgcatcagga tggcggtttt
 361 agtgagtatt tgagcgtgcc ggtggcgaac attttgcccg cagacggtat tgacccgcag
 421 gcggcagcat tgattgaacc tttcgctatt agcgctcatg cggtgcgtcg cgcagccatt
 481 gctcccggcg agcaggtgct ggtggtcggg gcggggccaa tcggtctggg cgcggcggca
 541 atcgctaaag ccgatggcgc acaggtggtg gtggcggata ccagtccggc gcgccgtgaa
 601 catgtggcaa cgcgtctgga attacctta ctggacccgt cagccgaaga ttttgacgcg
 661 cagctacggg cgcagtttgg tggttcgctg gcgcagaaag tgatcgacgc gacaggtaat
 721 caacatgcga tgaataacac cgtgaatttg attcgtcacg cggcacggt ggtatttgtc
 781 ggcctgttta aaggtgagtt gcagttctcc gatccggaat tccataaaaa agaaacgacg
 841 atgatgggca ccgcaacgc cacgccggaa gattttgcta agtcggtcg actgatggcg
 901 gaaggaaaaa tcactgctga catgatgtta acccatcgct atccgttcgc cacgctggca
 961 gaaacctacg agcgcgatgt gattaacaat cgtgagttaa ttaaaggcgt aattactttc
1021 tga
```

Amino acid sequence (SEQ ID NO:108)
```
   1 mstmnvlicq qpkelvwkqr eipipgdnea likiksvgic gtdihawggn qpffsyprvl
  61 gheicgeivg lgkniadlkn gqqvavipyv acqqcpacks grtnccekis vigvhqdggf
 121 seylsvpvan ilpadgidpq aaaliepfai sahavrraai apgeqvlvvg agpiglgaaa
 181 iakadgaqvv vadtsparre hvatrlelpl ldpsaedfda qlraqfggsl aqkvidatgn
```

FIG. 10F

```
241 qhamnntvnl irhggtvvfv glfkgelqfs dpefhkkett mmgsrnatpe dfakvgrlma
301 egkitadmml thrypfatla etyerdvinn relikgvitf
``` rspB (NP_416097)

Nucleotide sequence (SEQ ID NO:109)

```
  1 atgaaaagca tattaattga aaaaccgaat caactggcga ttgtcgaacg tgaaataccc
 61 accccgtcag cgggtgaagt acgagtaaaa gtgaaacttg ccggaatttg tggttcagat
121 agccatattt atcgtgggca taatcctttt gcgaaatatc cgcgcgtcat tggtcatgaa
181 ttctttggcg tcattgatgc agtgggtgaa ggcgtggaaa gcgccagagt cggtgaacgt
241 gttgctgtcg atccggtggt cagctgtggg cattgctatc cgtgctctat aggtaaaccg
301 aacgtttgta cgacactggc tgtattaggt gtgcacgctg acggtggttt cagtgaatat
361 gccgtggttc cggcaaaaaa tgcgtggaaa attcctgaag cagtggccga tcaatatgcg
421 gtaatgatcg aacctttac cattgcggct aacgtaaccg gacatggtca accgactgaa
481 aatgataccg ttctggttta tggtgccggt ccaatcggcc tgacgatcgt tcaggtatta
541 aaaggcgtct ataacgttaa aaatgtgatt gttgccgatc gcattgatga acgactggaa
601 aaagcgaaag agagcggggc tgactgggcg attaataaca gccagacacc gcttggcgag
661 attttcactg aaaaaggcat caagccgaca ttaattatcg atgcggcttg tcatccttct
721 atcctgaaag aggccgtaac gctggcttct ccagcggcac gtattgtatt gatggggttc
781 tccagtgaac cgtctgaagt gattcagcaa ggattaccg gaaaagaact ctctattttc
841 tcttcacgct taaattcccg atcgttatcg actgattaag taaagggtta
901 attaaaccag aaaaattaat tacccatacg tttgatttcc agcatgttgc tgatgccatt
961 agtttatttg aacaggatca aaaacattgc tgcaaagtct tactcacttt ttctgaataa
```

Amino acid sequence (SEQ ID NO:110)

```
  1 mksiliekpn qlaivereip tpsagevrvk vklagicgsd shiyrghnpf akyprvighe
 61 ffgvidavge gvesarvger vavdpvvscg hcypcsigkp nvcttlavlg vhadggfsey
121 avvpaknawk ipeavadqya vmiepftiaa nvtghgqpte ndtvlvygag pigltivqvl
181 kgvynvknvi vadriderle kakesgadwa innsqtplge iftekgikpt liidaachps
241 ilkeavtlas paarivlmgf ssepseviqq gitgkelsif ssrlnankfp ividwlskgl
301 ikpeklitht fdfqhvadai slfeqdqkhc ckvlltfse
``` gatD (NP_416594)

Nucleotide sequence (SEQ ID NO:111)

```
   1 atgaaatcag tggtgaatga tactgatggt atcgtgcgcg ttgcagaaag cgtcattcct
  61 gaaattaaac atcaggatga ggtgcgggta aaaattgcca gctcgggctt atgtggttcc
 121 gatttaccca ggatatttaa aaatggtgca cattattatc caataacgtt aggccatgaa
 181 tttagcggct atattgatgc ggtgggatcc ggtgttgatg atttacaccc tggcgatgcg
 241 gttgcctgtg tgccgttatt accctgtttt acttgtccag agtgtctgaa agggttttat
 301 tcccagtgcg caaaatatga ttttattggc tcgcggcgtg atggtggatt tgctgaatat
 361 attgtcgtta agcgaaaaaa tgtctttgct ctacccacgg atatgcctat tgaggatggg
 421 gcttttattg agccgattac cgttggtctg catgcttttc atttagcgca aggttgtgag
 481 aataaaaacg ttattattat tggtgccgga accattggcc tgctggccat tcagtgcgct
 541 gtcgcgctgg gagcaaagag tgtgacggcg atcgacatta gttcagaaaa actggcactg
 601 gcaaaatctt tcggtgcgat gcaacatttt aacagtagcg aaatgagcgc gccgcaaatg
 661 cagagcgttt tacgcgaact gcgctttaat cagcttatcc tcgagacggc tggcgtaccg
 721 caaactgtcg aactggcggt agagattgcc ggtcctcatg cccaactggc gctggtgggc
 781 acgttgcatc aggatctgca tttaacatcg gcaacgtttg gcaaatatt gcgtaaagag
 841 ctgacggtta tcggcagttg gatgaactac tccagcccctt ggccggggca ggagtgggaa
 901 acggcgagcc ggttgctgac agaacgtaag ttaagcctgg agccattaat cgctcaccgt
 961 ggaagctttg aaagcttcgc ccaggcggtg cgtgacatcg ctcgtaatgc tatgccgggc
1021 aaagtgttgc tcattccctg a
```

Amino acid sequence (SEQ ID NO:112)

```
  1 mksvvndtdg ivrvaesvip eikhqdevrv kiassglcgs dlprifknga hyypitlghe
 61 fsgyidavgs gvddlhpgda vacvpllpcf tcpeclkgfy sqcakydfig srrdggfaey
121 ivvkrknvfa lptdmpicdg afiepitvgl hafhlaqgce nknviiigag tigllaiqca
181 valgaksvta idisseklal aksfgamqtf nssemsapqm qsvlrelrfn qliletagvp
```

FIG. 10G

```
241 qtvelaveia gphaqlalvg tlhqdlhlts atfgkilrke ltvigswmny sspwpgqewe
301 tasrllterk lsleplianhr gsfesfaqav rdiarnampg kvllip
``` yphC (NP_417040)

Nucleotide sequence (SEQ ID NO:113)

```
   1 atgaaaacga tgctggcagc ttatttacca ggaaattcga ccgtcgatct gcgggaagtt
  61 gcggtgccga cgccggggat taaccaggta ctgatcaaaa tgaaatcctc cgggatttgc
 121 ggaagcgatg tccactatat ctatcatcaa caccgtgcca cagcggcggc acccgataaa
 181 ccgttatacc agggctttat caacggtcat gaaccgtgcg ggcagattgt ggcgatgggg
 241 caaggctgcc gccattttaa agagggcgac cgcgtgctgg tgtatcacat ttctggctgt
 301 ggttttttgcc cgaactgccg tcgcggtttt cctatttctt gtactggcga aggaaaagcg
 361 gcttacggct ggcagcgtga cggcggtcat gccgaatact tgctggcgga agaaaaagat
 421 ctgatcctcc tgccggatgc gctgagctac gaagatggtg cgtttatcag ttgcggcgtt
 481 ggtacagcgt atgaaggaat tttgcgcggc gaagtttccg gcagtgataa cgtgctggtg
 541 gtcggtctgg ggccagtcgg catgatggcg atgatgctgg cgaaaggtcg cggtgcaaaa
 601 cggatcatcg gcgttgatat gctgccggaa cgtctggcga tggcaaaaca gttaggggtg
 661 atggatcacg gctatttagc aaccaccgaa ggtctgccgc agattatcgc cgaactcacc
 721 cacggtggcg cggatgttgc gctcgattgt tccggtaatg ccgcaggtcg cttgctggca
 781 ctgcaatcca ccgctgactg gggacgggtg gtttacattg gtgaaaccgg aaaagtggaa
 841 ttcgaggtca cgccgatct gatgcaccat caacggcgga ttatcggctc ctgggtgacc
 901 agtctgttcc atatggaaaa atgcgcccat gatctgacgg actggaagct gtggccgcgt
 961 aacgccatta cccatcgctt ctcgctggaa caggcaggtg atgcctatgc gctgatggcg
1021 agcggcaaat gcggaaagt tgtgattaac ttcccggatt aa
```

Amino acid sequence (SEQ ID NO:114)

```
  1 mktmlaaylp gnstvdlrev avptpginqv likmkssgic gsdvhyiyhq hrataaapdk
 61 plyqgfingh epcgqivamg qgcrhfkegd rvlvyhisgc gfcpncrrgf pisctgegka
121 aygwqrdggh aeyllaeekd lilpdalsy edgafiscgv gtayegilrg evsgsdnvlv
181 vglgpvgmma mmlakgrgak riigvdmlpe rlamakqlgv mdhgylatte glpqiiaelt
241 hggadvaldc sgnaagrlla lqstadwgrv vyigetgkve fevsadlmhh qrriigswvt
301 slfhmekcah dltdwklwpr naithrfsle qagdayalma sgkcgkvvin fpd
``` yhdH (NP_417719)

Nucleotide sequence (SEQ ID NO:115)

```
   1 atgcaggcgt tactttttaga acagcaggac ggcaaaactc tcgcatcagt acagactctg
  61 gacgaaagtc gcctgccgga gggcgatgtc acggtcgatg ttcactggtc gagcctgaac
 121 tataaagatg cgctggcgat taccggtaag ggaaaaatca tccgtaattt tccgatgatt
 181 cctggggatcg attttgccgg aactgtacgc accagcgaag atccgcgttt tcatgccggt
 241 caggaggtgt tactcactgg ctgggcgtt ggtgaaaacc actggggtgg gctggcggag
 301 caggcgcgag tgaaaggtga ctggctggtt gccatgccgc aagggctgga cgcgcgtaaa
 361 gcaatgatta tcggtactgc cggttttacc gccatgctgt gtgtgatggc gctggaagat
 421 gccggtgttc gcccgcagga cggggagatt gtcgtgacgg gtgccagtgg tggcgtcggc
 481 agtaccgccg tggcgctgct gcataagttg ggttatcagg tcgttgccgt ttccggtcgc
 541 gaaagtaccc atgaatatct gaaaagttta ggtgctagcc gtgttctccc tcgtgatgag
 601 tttgccgaat cccgtcctct ggaaaaacaa gtctgggctg ggcaattga caccgttggc
 661 gacaaagtgc tggcaaaagt gctggcgcaa atgaattacg gcggctgcgt ggcggcctgt
 721 ggtctggcgg tggttttac tctgccaacc acggtcatgc catttattct cgtaatgtc
 781 cgtttgcaag gggtggattc agtaatgacg ccaccagaac gccgcgcaca agcctggcag
 841 cgactggtcg ccgattacc ggaatcattc tatacccagg cggcaaaaga gatatctctg
 901 tcagaggcac cgaactttgc cgaggccatc attaataacc agatccaggg tcgcacgctg
 961 gtgaaggtta actaa
```

Amino acid sequence (SEQ ID NO:116)

```
  1 mqallleqqd gktlasvqtl desrlpegdv tvdvhwssln ykdalaitgk gkiirnfpmi
 61 pgidfagtvr tsedprfhag qevlltgwgv genhwgglae qarvkgdwlv ampqglqark
121 amiigtagft amlcvmaled agvrpqdgei vvtgasggvg stavallhkl gyqvvavsgr
181 estheylksl gasrvlprde facsrplekq vwagaidtvg dkvlakvlaq mnyggcvaac
```

FIG. 10H

```
    241 glaggftlpt tvmpfilrnv rlqgvdsvmt pperraqawq rlvadlpesf ytqaakeisl
    301 seapnfaeai innqiqgrtl vkvn
``` ycjQ   (NP 415829)

Nucleotide sequence (SEQ ID NO:117)

```
      1 atgaaaaagt tagtagccac agcaccgcgt gttgctgcgc tggttgagta tgaagatcgg
     61 gcgattttag ctaatgaagt gaagatccgc gtgcgtttcg gcgcaccgaa acacggaacg
    121 gaagtggtcg acttccgcgc cgccagcccg tttattgatg aagactttaa cggcgaatgg
    181 cagatgttca ctccgcgtcc ggcagatgcg ccgcgcggca ttgagtttgg caaattccag
    241 cttggcaaca tggtggttca cgacattatc gagtgcggca gcgacgttac cgactacgcg
    301 gtgggcgaca gcgtatgcgg ctacggcccg ctctccgaga cggtcatcat taacgcagtg
    361 aataactaca agctgcgcaa aatgccgcaa ggcagctcct ggaaaaacgc cgtctgctac
    421 gacccggcgc agtttgccat gagcggcgtg cgcgatgcca acgtgcgcgt agggggatttt
    481 gtggtggtgg tagggcttgg cgcaatcggt caaattgcca tccaactggc taaacgcgct
    541 ggcgcttctg tggtgattgg cgtcgatcct atcgcccatc gctgtgatat tgcccgtcgc
    601 cacggcgcgg atttctgcct taacccatc ggcactgatg taggtaaaga gatcaaaacg
    661 ctgaccggca gcagggtgc cgatgtgatt atcgaaacca gcggctacgc cgacgcgctg
    721 caatcggcgc tccgcggtct ggcttatggc ggcaccatct cctatgtcgc gtttgccaag
    781 ccgtttgccg aaggttttaa cctcggacgc gaagcgcatt tcaataacgc caaaattgtc
    841 ttctctcgcg cgtgcagcga accgaacccg gattatccgc gctggagccg caagcgtatt
    901 gaagaaacct gttgggaact gctgatgaac ggttatctca attgcgaaga tttaatcgac
    961 ccggtggtga ccttttgccaa tagcccggaa agctatatgc agtatgtcga ccagcatccg
   1021 gaacagagca tcaaaatggg cgttacgttt taa
```

Amino acid sequence (SEQ ID NO:118)

```
      1 mkklvatapr vaalveyedr ailanevkir vrfgapkhgt evvdfraasp fidedfngew
     61 qmftprpada prgiefgkfq lgnmvvgdii ecgsdvtdya vgdsvcgygp lsetviinav
    121 nnyklrkmpq gsswknavcy dpaqfamsgv rdanvrvgdf vvvvglgaig qiaiqlakra
    181 gasvvigvdp iahrcdiarr hgadfclnpi gtdvgkeikt ltgkqgadvi ietsgyadal
    241 qsalrglayg gtisyvafak pfaegfnlgr eahfnnakiv fsracsepnp dyprwsrkri
    301 eetcwellmn gylncedlid pvvtfanspe symqyvdqhp eqsikmgvtf
``` yncB   (NP 415966)

Nucleotide sequence (SEQ ID NO:119)

```
      1 atggggcaac aaaagcagcg taatcgacgt tgggttctgg cctcgcgtcc acatggcgca
     61 cctgttccgg agaatttccg tcttgaagaa gatgatgtcg ccacaccggg tgaaggacag
    121 gtgttactgc gcacagttta tttgtccctg gacccgtata tgcgtggacg tatgagcgat
    181 gagccatctt attcaccgcc tgttgatatt ggcggcgtga tggtcggcgg tacggtgagc
    241 cgtgtcgtgg agtcgaatca tcctgattat cagtctggcg actgggtgct gggctacagt
    301 ggatggcaag actatgacat atccagtggt gatgatctgg tgaaacttgg cgatcatccg
    361 caaaatccat cgtggtcgct gggtgtgcta gggatgccag gctttaccgc ttatatgggc
    421 ctactggata tcggtcagcc taagagggc gaaacgttgg tggtagctgc ggcgacagga
    481 ccagtggggg cgacgtgggg gcaaatcggc aaacttaaag gttgcagagt ggtggggta
    541 gccggtggcg cggaaaaatg ccgccatgct accgaggtgt taggcttcga tgtttgtctt
    601 gatcaccacg cggatgattt tgccgaacaa ctggcgaaag cgtgcccaaa aggtattgat
    661 atctattatg aaaacgtggg cggtaaggta ttcgatgcgg tgctaccgtt acttaataca
    721 tctgcgcgca ttcccgtctg cggattagtg agcagctata acgctacaga gctaccaccc
    781 ggtccggatc gtttacctct gttgatggct acagtgctga aaaaacgtat tcgcttgcaa
    841 ggttttatta tcgctcagga ttatggtcac cgcatccatg agtttcagag ggagatgggg
    901 caatgggtga agaggataa aatccactac cgcgaagaaa ttactgacgg tttagagaat
    961 gcgccacaga cgtttatcgg cctgctgaag gtaaaaaact tcggcaaagt ggtgatccgc
   1021 gtggcgggtg atgattaa
```

Amino acid sequence (SEQ ID NO:120)

```
      1 mgqqkqrnrr wvlasrphga pvpenfrlee ddvatpgegq vllrtvylsl dpymrgrmsd
     61 epsysppvdi ggvmvggtvs rvvesnhpdy qsgdwvlgys gwqdydissg ddlvklgdhp
    121 qnpswslgvl gmpgftaymg lldigqpkeg etlvvaaatg pvgatvgqig klkgcrvvgv
```

FIG. 10I

```
181 aggaekcrha tevlgfdvcl dhhaddfaeq lakacpkgid iyyenvggkv fdavlpllnt
241 saripvcglv ssynatelpp gpdrlpllma tvlkkrirlq gfiiaqdygh rihefqremg
301 qwvkedkihy reeitdglen apqtfigllk gknfgkvvir vagdd
``` qor (NP 418475)

Nucleotide sequence (SEQ ID NO:121)

```
  1 atggcaacac gaattgaatt tcacaagcac ggtggcccgg aagtacttca agccgtagag
 61 ttcactcctg ccgatccggc ggagaatgaa atccaggtcg aaaataaagc catcggcatc
121 aattttatcg acacatatat ccgcagcggc ctttacccgc cgccatcgct acccagcgga
181 ttaggcaccg aagcagcagg catcgtgagt aaagtcggca gtggtgtaaa gcatattaag
241 gcaggcgatc gtgtagtcta tgcgcagtcg gcgttaggcg cttacagctc tgtgcataac
301 attattgcgg ataaagcggc gattctgcct gcggcaattt cttttgagca agctgcggca
361 tccttcctga aaggcttaac ggtttattat ctgctgcgca aaacctatga aattaaaccc
421 gatgaacagt tcctgttcca cgcagcggct ggcggcgttg gcttaattgc ctgccagtgg
481 gcaaaagccc tgggcgcgaa acttatcggc accgtaggaa ccgcgcaaaa agcgcagagc
541 gcgctaaaag cgggcgcgtg gcaggttatt aactatcgtg aagaggatct ggtcgagcgg
601 ttaaaagaga tcaccggcgg taagaaagtg cgcgtggtgt acgattccgt gggcagagac
661 acctgggaac ggtcgctgga ttgcctgcaa cgccgcggct taatggtcag ttttggcaac
721 tcatcaggtg cggttaccgg tgtgaactta ggcattctca atcaaaagg ctcgttgtat
781 gtgacacgcc cttccctgca aggctatatc accacgcggg aggaattaac cgaggccagt
841 aatgaactgt tctctttgat tgccagcggt gtgattaagg tcgatgtcgc cgagcagcag
901 aaatatccgc tgaaggatgc gcagcgtgcg catgagattc tggaaagccg ggcgacgcaa
961 ggttccagcc tgctgattcc ataa
```

Amino acid sequence (SEQ ID NO:122)

```
  1 matriefhkh ggpevlqave ftpadpaene iqvenkaigi nfidtyirsg lypppslpsg
 61 lgteaagivs kvgsgvkhik agdrvvyaqs algayssvhn iiadkaailp aaisfeqaaa
121 sflkgltvyy llrktyeikp deqflfhaaa ggvgliacqw akalgaklig tvgtaqkaqs
181 alkagawqvi nyreedlver lkeitggkkv rvvydsvgrd twersldclq rrglmvsfgn
241 ssgavtgvnl gilnqkgsly vtrpslqgyi ttreelteas nelfsliasg vikvdvaeqq
301 kyplkdaqra heilesratq gssllip
``` frmA (NP 414890)

Nucleotide sequence (SEQ ID NO:123)

```
   1 tcagtaacga attacggttc gaatggattt gccttcatgc atcaggtcga aggcgtcatt
  61 aatttcatcc aggctcatgg tatgcgtgac aaacggttcc agatcgatat cacctttcat
 121 cgcatcttca accatgcccg gtaactggga cgacctttc acgccgccaa acgcggaacc
 181 tttccatacg cgaccagtga ccaactggaa tggacgggtg agatttcct gaccggcaac
 241 cgcgaccccg atgatcaccg actgacccca gccgcggtgc gcactttcca gcgccgcacg
 301 catcacgttg acgttaccga tgcattcaaa ggtatggtcg atccccatt tgttgatatc
 361 caacaggaca tcttttatcg gtttgtcgta gtcattcggg ttaatgcagt cggtagcacc
 421 gaagcgacgc gccagatcga atttcttcgg gttggtatcg atagcgataa tccgacccgc
 481 tttcgcctga cgcgcgccct gaaccactgc agaccaatc gcgccaagac caaacacggc
 541 aacagaatca cctggctgga ctttagctgt gttgtgtacc gcgccaatac cggtggtcac
 601 gccacagcca agcaggcaga cgtgttcatg gtttgcttct ggattaattt ttgccagaga
 661 cacttccgcg actacggtgt attcactgaa tgtagagcaa cccatgtagt gataaagcgg
 721 ctgcccgttg taagaaaaac gggtggtgcc tgtctggcatc aggcctttac cctgggtttc
 781 gcgaaccgca acacagaggt tagttttgcc agaacgacag aactcacact cgccgcactc
 841 cgcggtgtaa agcgggatca catggtcgcc aggtttgacg ctggttacgc cttcaccgac
 901 ttcaaccaca acgccggccc cttcgtgacc gagaaccacc gggaatacac cttccgggtc
 961 atcgccggag agggtaaatg cgtcggtatg gcaaacgccg tatgggtga ctttaattag
1021 cacttcacct tttttcggtg gtgcaacgtc aatttcaacg atttccagcg gttaccggg
1081 agcaaatgca acggcagcac gtgatttcat
```

Amino acid sequence (SEQ ID NO:124)

```
  1 mksraavafa pgkpleivei dvappkkgev likvthtgvc htdaftlsgd dpegvfpvvl
 61 ghegagvvve vgegvtsvkp gdhviplyta ecgecefcrs gktnlcvavr etqgkglmpd
```

FIG. 10J

```
121 gttrfsyngq plyhymgcst fseytvvaev slakinpean hehvcllgcg vttgigavhn
181 takvqpgdsv avfglgaigl avvqgarqak agriiaidtn pkkfdlarrf gatdcinpnd
241 ydkpikdvll dinkwgidht fecignvnvm raalesahrg wgqsviigva vagqeistrp
301 fqlvtgrvwk gsafggvkgr sqlpgmveda mkgdidlepf vthtmsldei ndafdlmheg
361 ksirtviry
``` ybdR (NP_415141)

Nucleotide sequence (SEQ ID NO:125)

```
   1 atgaaagcat tgacttatca cggcccacat cacgttcagg tagaaaatgt tcccgatccg
  61 ggcgttgaac aggcagatga tattattctg cgtattacgg caacggcgat ctgtggctct
 121 gacctccatc tttatcgagg caaaatacct caggttaaac atggcgatat ttttggtcat
 181 gaatttatgg gggaagtagt tgaaaccgga aaggacgtaa aaaatttgca aaaaggcgac
 241 cgagtggtaa ttccgttcgt cattgcttgt ggcgactgtt ttttctgtcg attgcaacaa
 301 tatgccgcct gcgaaaatac caatgcgggt aaaggcgctg cgctcaataa aaaacagata
 361 ccagctccag cggcattgtt tggttatagt cacctgtatg gcggcgttcc tggtgggcag
 421 gcggaatatg tccgcgtccc taaagggaat gtggggccgt ttaaagtacc gcctttgctt
 481 tcagatgata aagcgctttt cctttctgat attctgccaa cggcatggca ggcagcaaaa
 541 aatgcgcaga tccaacaagg ttcaagcgtt gcagtctatg gtgctggtcc tgtgggattg
 601 ttgacaatcg cctgtgcacg gttgctcggt gcggaacaga tttttgttgt tgatcatcat
 661 ccctaccgct gcatttcgc cgccgaccgc tacgcgcga tcccgattaa ttttgatgaa
 721 gacagcgatc cggcacagtc aattattgaa caaacggcag gtcaccgggg cgtggatgca
 781 gtaatagacg ccgtcggttt tgaagcgaaa ggcagcacca cggaaacggt gctgactaac
 841 ctgaaactgg agggcagcag cggtaaagcg ttgcgtcagt gtattgcggc ggtcaggcgt
 901 ggcggcattg ttagcgtacc gggcgtctac gctggattta ttcacggttt cctgtttggc
 961 gacgcctttg ataaagggtt gtcgtttaaa atgggacaga cccacgttca cgcatggctg
1021 ggagaattat taccgttaat tgagaaagga ttactgaaac cagaagaaat tgttacccac
1081 tatatgccgt ttgaagaggc cgcccgggga tatgagattt cgaaaaacg tgaagaggag
1141 tgccgtaagg tgattctggt acccggtgca caagcgcag aggcggcgca gaaggcggtt
1201 tcaggtctgg tgaatgcgat gccggggggga acaatatga
```

Amino acid sequence (SEQ ID NO:126)

```
   1 mkaltyhgph hvqvenvpdp gveqaddiil ritataicgs dlhlyrgkip qvkhgdifgh
  61 efmgevvetg kdvknlqkgd rvvipfviac gdcffcrlqq yaacentnag kgaalnkkqi
 121 papaalfgys hlyggvpggq aeyvrvpkgn vgpfkvppll sddkalflsd ilptawqaak
 181 naqiqqgssv avygagpvgl ltiacarllg aeqifvvdhh pyrlhfaadr ygaipinfde
 241 dsdpaqsiie qtaghrgvda vidavgfeak gsttetvltn lklegssgka lrqciaavrr
 301 ggivsvpgvy agfihgflfg dafdkglsfk mgqthvhawl gellpliekg llkpeeivth
 361 ympfeeaarg yeifekreee crkvilvpga qsaeaaqkav sglvnampgg ti
```

YggP (YP_026187)

Nucleotide sequence (SEQ ID NO:127)

```
   1 atgaaaacca agttgctgc tatttatggc aagcgggatg tccgtctgcg cgtatttgaa
  61 ctgccagaaa ttaccgataa tgaattactg gtgagtgtaa tttctgacag cgtctgttta
 121 tcgacctgga aagcggcgtt actcggtagt gaacataaac gcgtacccga cgatttagaa
 181 aatcatccgg tcattaccgg gcatgaatgt gccggggtta ttgtcgaagt gggtaaaaat
 241 ctcactggca aatataaaaa aggccagcgt tttgtattgc aaccggcgat ggggttacca
 301 agcggatatt cagcgggcta cagctacgaa tattttggcg gcaatgccac ttatatgatt
 361 attcccgaaa tcgccattaa tttgggctgc gtattaccgt atcacggctc ttattttgct
 421 gcggcgtcgc tggcagagcc tatgtgctgc attattggtg cttatcatgc aattatcac
 481 accacgcaat atgtttatga gcatcgcatg ggcgtcaaac tggcggcaa tattgcactg
 541 ctgcgcgtgtg caggtccgat gggcgttggc gctatcgatt acgccattaa cggcggcata
 601 caaccgtcgc gggtggtggt ggtcgatatc gacgacaaac gtctggcgca ggtacagaag
 661 ctgctgccgg tgaactggc ggccagtaaa ggcattgagc tggtgtatgt gaataccaaa
 721 gggatgagcg atcctgtcca gatgctgcgg gcgctgacag gagatgccgg gttcgatgac
 781 attttgtttt atgcggcggt gcctgctgtc gttgagatgg ctgatgaatt actggcggaa
 841 gatggctgtc tgaacttctt tgccgggccg acggataaaa acttcaaagt gccgtttaat
 901 ttctacaacg tccattacaa cagcacgcac gtcgtcggta catctggcgg ttcaacggac
```

FIG. 10K

```
 961 gacatgaaag aggcgattgc ccttagcgcc actgggcagt tacagccgtc gtttatggtg
1021 acccatatcg gtggcctgga tgcggtgcca gaaaccgtgc tcaatctgcc ggatatccct
1081 ggcggtaaaa aactcattta taacggcgtg accatgccgc tcactgccat tgccgatttt
1141 gccgaaaaag gcaaaaccga tccgctgttt aaagagttgg cgcggctggt tgaggaaacg
1201 cacggcatct ggaatgaaca ggccgagaaa tatctgctgg cacaatttgg cgttgatatc
1261 ggggaggccg cgcaatga
```

Amino acid sequence (SEQ ID NO:128)

```
  1 mktkvaaiyg krdvrlrvfe lpeitdnell vsvisdsvcl stwkaallgs ehkrvpddle
 61 nhpvitghec agvivevgkn ltgkykkgqr fvlqpamglp sgysagysye yfggnatymi
121 ipeiainlgc vlpyhgsyfa aaslaepmcc iigayhanyh ttqyvyehrm gvkpggnial
181 lacagpmgig aidyainggi qpsrvvvvdi ddkrlaqvqk llpvelaask gielvyvntk
241 gmsdpvqmlr altgdagfdd ifvyaavpav vemadellae dgclnffagp tdknfkvpfn
301 fynvhynsth vvgtsgqstd dmkeaialsa tgqlqpsfmv thiggldavp etvlnlpdip
361 ggkkliyngv tmpltaiadf aekgktdplf kelarlveet hgiwneqaek yllaqfgvdi
421 geaaq
```

YiaY (YP 026233)

Nucleotide sequence (SEQ ID NO:129)

```
   1 atggcagctt caacgttctt tattccttct gtgaatgtca tcggcgctga ttcattgact
  61 gatgcaatga atatgatggc agattatgga tttacccgta ccttaattgt cactgacaat
 121 atgttaacga aattaggtat ggcgggcgat gtgcaaaaag cactggaaga acgcaatatt
 181 tttagcgtta tttatgatgg cacccaacct aaccccacca cggaaaacgt cgccgcaggt
 241 ttgaaattac ttaaagagaa taattgcgat agcgtgatct ccttaggcgg tggttctcca
 301 cacgactgcg caaaaggtat tgcgctggtg cagccaatgc gcggcgatat cgcgattac
 361 gaaggcgttg accgctctgc aaaaccgcag ctgccgatga tcgccatcaa taccacggcg
 421 ggtacggcct ctgaaatgac ccgtttctgc atcatcactg acgaagcgcg tcatatcaaa
 481 atggcgattg ttgataaaca tgtcactccg ctgctttctg tcaatgactc ctctctgatg
 541 attggtatgc cgaagtcact gaccgccgca acgggtatgg atgccttaac gcacgctatc
 601 gaagcatatg tttctattgc cgccacgccg atcactgacg cttgtgcact gaaagccgtg
 661 accatgattg ccgaaaacct gccgttagcc gttgaagatg gcagtaatgc gaaagcgcgt
 721 gaagcaatgg cttatgccca gttcctcgcc ggtatggcgt tcaataatgc ttctctgggt
 781 tatgttcatg cgatggcgca ccagctgggc ggtttctaca acctgccaca cggtgtatgt
 841 aacgccgttt tgctgccgca cgttcaggta ttcaacagca agtcgccgc tgcacgtctg
 901 cgtgactgtg ccgctgcaat gggcgtgaac gtgacaggta aaaacgacgc ggaaggtgct
 961 gaagcctgca ttaacgccat ccgtgaactg gcgaagaaag tggatatccc ggcaggccta
1021 cgcgacctga acgtgaaaga agaagatttc gcggtattgg cgactaatgc cctgaaagat
1081 gcctgtggct ttactaaccc gatccaggca actcacgaag aaattgtggc gatttatcgc
1141 gcagcgatgt aa
```

Amino acid sequence (SEQ ID NO:130)

```
  1 maastffips vnvigadslt damnmmadyg ftrtlivtdn mltklgmagd vqkaleerni
 61 fsviydgtqp nptenvaag lkllkenncd svislgggsp hdcakgialv aanggdirdy
121 egvdrsakpq lpmiaintta gtasemtrfc iitdearhik maivdkhvtp llsvndsslm
181 igmpksltaa tgmdalthai eayvsiaatp itdacalkav tmiaenlpla vedgsnakar
241 eamayaqfla gmafnnaslg yvhamahqlg gfynlphgvc navllphvqv fnskvaaarl
301 rdcaaamgvn vtgkndaega eacinairel akkvdipagl rdlnvkeedf avlatnalkd
361 acgftnpiqa theeivaiyr aam
```

FucO (NP 417279)

(Nucleotide sequence (SEQ ID NO:131)

```
  1 atgatggcta acagaatgat tctgaacgaa acggcatggt ttggtcgggg tgctgttggg
 61 gctttaaccg atgaggtgaa acgccgtggt tatcagaagg cgctgatcgt caccgataaa
121 acgctggtgc aatgctggcg ggtgacgata agatggatgc tgcagggctg
181 gcatggcga tttacgacgt cgtagtgccc aacccaacaa ttactgtcgt caaagaaggg
241 ctcggtgtat tccagaatag cggcgcggat tacctgatcg ctattggtgg tggttctcca
301 caggatactt gtaaagcgat tggcattatc agcaacaacc cggagtttgc cgatgtgcgt
```

FIG. 10L

```
 361 agcctggaag ggctttcccc gaccaataaa cccagtgtac cgattctggc aattcctacc
 421 acagcaggta ctgcggcaga agtgaccatt aactacgtga tcactgacga agagaaacgg
 481 cgcaagtttg tttgcgttga tccgcatgat atcccgcagg tggcgtttat tgacgctgac
 541 atgatggatg gtatgcctcc agcgctgaaa gctgcgacgg tgtcgatgc gctcactcat
 601 gctattgagg gtatattac ccgtggcgcg tgggcgctaa ccgatgcact gcacattaaa
 661 gcgattgaaa tcattgctgg ggcgctgcga ggatcggttg ctggtgataa ggatgccgga
 721 gaagaaatgg cgctcgggca gtatgttgcg ggtatgggct ctcgaatgt tgggttaggg
 781 ttggtgcatg gtatggcgca tccactgggc gcgtttata acactccaca cggtgttgcg
 841 aacgccatcc tgttaccgca tgtcatgcgt tataacgctg actttaccgg tgagaagtac
 901 cgcgatatcg cgcgcgttat gggcgtgaaa gtggaaggta tgagcctgga agaggcgcgt
 961 aatgccgctg ttgaagcggt gtttgctctc aaccgtgatg tcggtattcc gccacatttg
1021 cgtgatgttg gtgtacgcaa ggaagacatt ccggcactgg cgcaggcggc actggatgat
1081 gtttgtaccg gtggcaaccc gcgtgaagca acgcttgagg atattgtaga gctttaccat
1141 accgcctggt aa
```

Amino acid sequence (SEQ ID NO:132)

```
  1 mmanrmilne tawfgrgavg altdevkrrg yqkalivtdk tlvqcgvvak vtdkmdaagl
 61 awaiydgvvp nptitvvkeg lgvfqnsgad yliaigggsp qdtckaigii snnpefadvr
121 sleglsptnk psvpilaipt tagtaaevti nyvitdeekr rkfvcvdphd ipqvafidad
181 mmdgmppalk aatgvdalth aiegyitrga waltdalhik aieiiagalr gsvagdkdag
241 eemalgqyva gmgfsnvglg lvhgmahplg afyntphgva naillphvmr ynadftgeky
301 rdiarvmgvk vegmsleear naaveavfal nrdvgipphl rdvgvrkedi palaqaaldd
361 vctggnprea tledivelyh taw
```

EutG (NP 416948)

Nucleotide sequence (SEQ ID NO:133)

```
   1 atgcaaaatg aattgcagac cgcgctcttt caggcgttcg ataccctgaa tctgcaacgg
  61 gtaaaaacat ttagcgttcc accggtgacg cttttgcggtc cgggctcggt gagcagttgc
 121 ggacagcaag cgcaaacgcg tgggctgaaa catctgttcg tgatggcaga cagctttttg
 181 catcaggcag ggatgaccgc cgggctgacg cgtagcctga ccgttaaagg tatcgccatg
 241 acgctctggc catgtccggt gggcgaaccg tgcattaccg acgtgtgtgc agccgtggcg
 301 cagttgcgtg agtcaggctg tgatggggtg atcgcgtttg gcggcggctc ggtgctggat
 361 gcggcgaaag ccgtgacgtt gctggtgacg aacccggata gcacgctggc agagatgtca
 421 gaaaccagcg ttctgcaacc gcgcttgccg ctgattgcca ttccaactac cgccggaacc
 481 ggctctgaaa ccaccaatgt aacggtgatt atcgacgcgg tgagcgggcg caagcaggtg
 541 ttagcccatg cctcgctgat gccggatgtg gcgatcctgg acgccgcatt gaccgaaggt
 601 gtgccgtcgc atgtcacggc gatgaccggc attgatgcgt taacccatgc cattgaagca
 661 tacagcgccc tgaacgctac accgtttacc gacagtctgg cgattggtgc cattgcgatg
 721 attggcaaat cgctgccgaa agcggtgggc tacggtcacg accttgccgc gcgcgagagc
 781 atgttgctgg cttcatgtat ggcgggaatg gcgttttcca gtgcgggtct ggggttgtgc
 841 cacgcgatgg cgcatcagcc gggcgcggcg ctgcatattc gcacggtct cgcgaacgcc
 901 atgttgctgc caacggtgat ggaatttaac cggatggttt gtcgtgaacg ctttagtcag
 961 attggtcggg cactgcgaac taaaaaatcc gacgatcgtg acgctattaa cgcggtaagt
1021 gagctgattg cggaagttgg gattggtaaa cgactgggcg atgttggtgc gacatctgcg
1081 cattacggcg catgggcgca ggccgcgctg gaagatattt gtctgcgcag taacccgcgt
1141 accgccagcc tggagcagat tgtcggcctg tacgcagcgg cgcaataa
```

Amino acid sequence (SEQ ID NO:134)

```
  1 mqnelqtalf qafdtlnlqr vktfsvppvt lcgpgsvssc gqqaqtrglk hlfvmadsfl
 61 hqagmtaglt rsltvkgiam tlwpcpvgep citdvcaava qlresgcdgv iafgggsvld
121 aakavtllvt npdstlaems etsvlqprlp liapttagt gsettnvtvi idavsgrkqv
181 lahaslmpdv aildaalteg vpshvtamtg idalthaiea ysalnatpft dslaigaiam
241 igkslpkavg yghdlaares mllascmagm afssaglglc hamahqpgaa lhiphglana
301 mllptvmefn rmvcrerfsq igralrtkks ddrdainavs eliaevgigk rlgdvgatsa
361 hygawaqaal ediclrsnpr tasleqivgl yaaaq
```

FIG. 10M

YqhD (NP_417484)

Nucleotide sequence (SEQ ID NO:135)

```
   1 atgaacaact taatctgca caccccaacc cgcattctgt ttggtaaagg cgcaatcgct
  61 ggtttacgcg aacaaattcc tcacgatgct cgcgtattga ttacctacgg cggcggcagc
 121 gtgaaaaaaa ccggcgttct cgatcaagtt ctggatgccc tgaaaggcat ggacgtgctg
 181 gaatttggcg gtattgagcc aaaccggct tatgaaacgc tgatgaacgc cgtgaaactg
 241 gttcgcgaac agaaagtgac tttcctgctg gcggttggcg gcggttctgt actggacggc
 301 accaaattta tcgccgcagc ggctaactat ccggaaaata tcgatccgtg gcacattctg
 361 caaacgggcg gtaaagagat taaagcgcgc atcccgatgg gctgtgtgct gacgctgcca
 421 gcaaccggtt cagaatccaa cgcaggcgcg gtgatctccc gtaaaaccac aggcgacaag
 481 caggcgttcc attctgccca tgttcagccg gtatttgccg tgctcgatcc ggtttatacc
 541 tacaccctgc cgccgcgtca ggtggctaac ggcgtagtgg acgcctttgt acacaccgtg
 601 gaacagtatg ttaccaaacc ggttgatgcc aaaattcagg accgtttcgc agaaggcatt
 661 ttgctgacgc taatcgaaga tggtccgaaa gccctgaaag agccagaaaa ctacgatgtg
 721 cgcgccaacg tcatgtgggc ggcgactcag gcgctgaacg gtttgattgg cgctggcgta
 781 ccgcaggact gggcaacgca tatgctgggc acgaactga ctgcgatgca cggtctggat
 841 cacgcgcaaa cactggctat cgtcctgcct gcactgtgga tgaaaaacg cgataccaag
 901 cgcgctaagc tgctgcaata tgctgaacgc gtctggaaca tcactgaagg ttccgatgat
 961 gagcgtattg acgccgcgat tgccgcaacc cgcaatttct tgagcaatt aggcgtgccg
1021 acccacctct ccgactacgg tctggacggc agctccatcc cggctttgct gaaaaaactg
1081 gaagagcacg gcatgaccca actgggcgaa atcatgaca ttacgttgga tgtcagccgc
1141 cgtatatacg aagccgcccg ctaa
```

Amino acid sequence (SEQ ID NO:136)

```
   1 mnnfnlhtpt rilfgkgaia glreqiphda rvlityggs vkktgvldqv ldalkgmdvl
  61 efggiepnpa yetlmnavkl vreqkvtfll avgggsvldg tkfiaaaany penidpwhil
 121 qtggkeiksa ipmgcvltlp atgsesnaga visrkttgdk qafhsahvqp vfavldpvyt
 181 ytlpprqvan gvvdafvhtv eqyvtkpvda kiqdrfaegi lltliedgpk alkepenydv
 241 ranvmwaatq alngligagv pqdwathmlg heltamhgld haqtlaivlp alwnekrdtk
 301 rakllqyaer vwnitegsdd eridaaiaat rnffeqlgvp thlsdygldg ssipallkkl
 361 eehgmtqlge nhditldvsr riyeaar
```

AdhE (NP_415757)

Nucleotide sequence (SEQ ID NO:137)

```
   1 atggctgtta ctaatgtcgc tgaacttaac gcactcgtag agcgtgtaaa aaaagcccag
  61 cgtgaatatg ccagtttcac tcaagagcaa gtagacaaaa tcttccgcgc cgccgctctg
 121 gctgctgcag atgctcgaat cccactcgcg aaaatggccg ttgccgaatc cggcatggt
 181 atcgtcgaag ataaagtgat caaaaccac tttgcttctg aatatatcta caacgcctat
 241 aaagatgaaa aaacctgtgg tgttctgtct gaagacgaca cttttggtac catcactatc
 301 gctgaaccaa tcggtattat ttgcggtatc gttccgacca ctaacccgac ttcaactgct
 361 atcttcaaat cgctgatcag tctgaagacc cgtaacgcca ttatcttctc cccgcaccg
 421 cgtgcaaaag atgccaccaa caaagcggct gatatcgttc tgcaggctgc tatcgctgcc
 481 ggtgctccga aagatctgat cggctggatc gatcaacctt ctgttgaact gtctaacgca
 541 ctgatgcacc acccagacat caacctgatc ctcgcgactg gtggtccggg catggttaaa
 601 gccgcataca gctccggtaa accagctatc ggtgtaggcg cgggcaacac tccagttgtt
 661 atcgatgaaa ctgcggatat caaacgtgca gttgcatctg tactgatgtc caaaaccttc
 721 gacaacggcg taatctgtgc ttctgaacag tctgttgttg ttgttgactc tgtttatgac
 781 gctgtacgtg aacgttttgc aacccacggc ggctatctgt gcagggtaa agagctgaaa
 841 gctgttcagg atgttatcct gaaaaacggt gcgctgaacg cggctatcgt tggtcagcca
 901 gcctataaaa ttgctgaact ggcaggcttc tctgtaccag aaaacaccaa gattctgatc
 961 ggtgaagtga ccgttgttga tgaaagcgaa ccgttcgcac atgaaaaact gtccccgact
1021 ctggcaatgt accgcgctaa agatttcgaa gacgcggtag aaaagcaga gaactggtt
1081 gctatgggcg gtatcggtca tacctcttgc ctgtacactg accaggataa ccaaccggct
1141 cgcgtttctt acttcggtca gaaatgaaa acggcgcgta tcctgattaa caccccagcg
1201 tctcagggtg gtatcggtga cctgtataac ttcaaactcg caccttccct gactctgggt
1261 tgtggttctt ggggtggtaa ctccatctct gaaaacgttg gtccgaaaca cctgatcaac
```

FIG. 10N

```
1321 aagaaaaccg ttgctaagcg agctgaaaac atgttgtggc acaaacttcc gaaatctatc
1381 tacttccgcc gtggctccct gccaatcgcg ctggatgaag tgattactga tggccacaaa
1441 cgtgcgctca tcgtgactga ccgcttcctg ttcaacaatg gttatgctga tcagatcact
1501 tccgtactga aagcagcagg cgttgaaact gaagtcttct tcgaagtaga agcggacccg
1561 accctgagca tcgttcgtaa aggtgcagaa ctggcaaact ccttcaaacc agacgtgatt
1621 atcgcgctgg gtggtggttc cccgatggac gccgcgaaga tcatgtgggt tatgtacgaa
1681 catccggaaa ctcacttcga agagctggcg ctgcgcttta tggatatccg taaacgtatc
1741 tacaagttcc cgaaaatggg cgtgaaagcg aaaatgatcg ctgtcaccac cacttctggt
1801 acaggttctg aagtcactcc gtttgcggtt gtaactgacg acgctactgg tcagaaatat
1861 ccgctggcag actatgcgct gactccggat atggcgattg tcgacgccaa cctggttatg
1921 gacatgccga gtccctgtg tgctttcggt ggtctggacg cagtaactca cgccatggaa
1981 gcttatgttt ctgtactggc atctgagttc tctgatggtc aggctctgca ggcactgaaa
2041 ctgctgaaag aatatctgcc agcgtcctac cacgaagggt ctaaaaatcc ggtagcgcgt
2101 gaacgtgttc acagtgcagc gactatcgcg ggtatcgcgt ttgcgaacgc cttcctgggt
2161 gtatgtcact caatggcgca caaactgggt tcccagttcc atattccgca cggtctggca
2221 aacgccctgc tgatttgtaa cgttattcgc tacaatgcga acgacaaccc gaccaagcag
2281 actgcattca gccagtatga ccgtccgcag gctcgccgtc gttatgctga aattgccgac
2341 cacttgggtc tgagcgcacc gggcgaccgt actgctgcta agatcgagaa actgctggca
2401 tggctggaaa cgctgaaagc tgaactgggt attccgaaat ctatccgtga agctggcgtt
2461 caggaagcag acttcctggc gaacgtggat aaactgtctg aagatgcatt cgatgaccag
2521 tgcaccggcg ctaacccgcg ttacccgctg atctccgagc tgaaacagat tctgctggat
2581 acctactacg gtcgtgatta tgtagaaggt gaaactgcag cgaagaaaga agctgctccg
2641 gctaaagctg agaaaaaagc gaaaaaatcc gcttaa
```

Amino acid sequence (SEQ ID NO:138)

```
  1 mavtnvaeln alvervkkaq reyasftqeq vdkifraaal aaadaripla kmavaesgmg
 61 ivedkviknh faseyiynay kdektcgvls eddtfgtiti aepigiicgi vpttnptsta
121 ifkslislkt rnaiifsphp rakdatnkaa divlqaaiaa gapkdligwi dqpsvelsna
181 lmhhpdinli latggpgmvk ayssgkpai gvgagntpvv idetadikra vasvlmsktf
241 dngvicaseq svvvvdsvyd avrerfathg gyllqgkelk avqdvilkng alnaaivgqp
301 aykiaelagf svpentkili gevtvvdese pfaheklspt lamyrakdfe davekaeklv
361 amggightsc lytdqdnqpa rvsyfgqkmk tarilintpa sqggigdlyn fklapsltlg
421 cgswggnsis envgpkhlin kktvakraen mlwhklpksi yfrrgslpia ldevitdghk
481 ralivtdrfl fnngyadqit svlkaagvet evffeveadp tlsivrkgae lansfkpdvi
541 ialgggspmd aakimwvmye hpethfeela lrfmdirkri ykfpkmgvka kmiavtttsg
601 tgsevtpfav vtddatgqky pladyaltpd maivdanlvm dmpkslcafg gldavthame
661 ayvsvlasef sdgqalqalk llkeylpasy hegsknpvar ervhsaatia giafanaflg
721 vchsmahklg sqfhiphgla nallicnvir ynandnptkq tafsqydrpq arrryaeiad
781 hlglsapgdr taakiekla wletlkaelg ipksireagv qeadflanvd klsedafddq
841 ctganprypl iselkqilld tyygrdyveg etaakkeaap akaekkakks a
``` dkgB (NP_414743)

Nucleotide sequence (SEQ ID NO:139)

```
  1 atggctatcc tgcatttgg tttaggtact ttccgtctga aagacgacgt tgttatttca
 61 tctgtgataa cggcgcttga acttggttat cgcgcaattg ataccgcaca aatctatgat
121 aacgaagccg cagtaggtca ggcgattgca gaaagtggcg tgccacgtca tgaactctac
181 atcaccacta aaatctggat tgaaatactc agccaagcaa aattgatccc aagtctgaaa
241 gagagcctgc aaaaattgcg taccgattat gttgatctga cgctaatcca ctggccgtca
301 ccaaacgatg aagtctctgt tgaagagttt atgcaggcgc tgctggaagc caaaaaacaa
361 gggctgacgc gtgagatcgg tatttccaac ttcacgatcc cgttgatgga aaaagcgatt
421 gctgctgttg gtgctgaaaa catcgctact aaccagattg aactctctcc ttatctgcaa
481 aaccgtaaag tggttgcctg gctaaacag cacggcatcc atattacttc ctatatgacg
541 ctggcgtatg gtaaggccct gaaagatgag gttattgctc gtatcgcagc taaacacaat
601 gcgactccgg cacaagtgat tctggcgtgg gctatggggg aaggttactc agtaattcct
661 tcttctacta aacgtaaaaa cctggaaagt aatcttaagg cacaaaattt acagcttgat
721 gccgaagata aaaagcgat cgccgcactg gattgcaacg accgcctggt tagcccggaa
781 ggtctggctc ctgaatggga ttaa
```

FIG. 10O

Amino acid sequence (SEQ ID NO:140)

```
  1 maipafglgt frlkddvvis svitalelgy raidtaqiyd neaavgqaia esgvprhely
 61 ittkiwienl skdklipslk eslqklrtdy vdltlihwps pndevsveef mqalleakkq
121 gltreigisn ftiplmekai aavgaeniat nqielspylq nrkvvawakq hgihitsymt
181 laygkalkde viariaakhn atpaqvilaw amgegysvip sstkrknles nlkaqnlqld
241 aedkkaiaal dcndrlvspe glapewd
```

YdjG (NP 416285)

Nucleotide sequence (SEQ ID NO:141)

```
  1 atgaaaaaga taccctttagg cacaacggat attacgcttt cgcgaatggg gttggggaca
 61 tgggccattg gcggcggtcc tgcatggaat ggcgatctcg atcggcaaat atgtattgat
121 acgattcttg aagcccatcg ttgtggcatt aatctgattg atactgcgcc aggatataac
181 tttggcaata gtgaagttat cgtcggtcag gcgttaaaaa aactgccccg tgaacaggtt
241 gtagtagaaa ccaaatgcgg cattgtctgg gaacgaaaag gaagtttatt caacaaagtt
301 ggcgatcggc agttgtataa aaacctttcc ccggaatcta tccgcgaaga ggtagcagcg
361 agcttgcaac gtctgggtat tgattacatc gatatctaca tgacgcactg gcagtcggtg
421 ccgccatttt ttacgccgat cgctgaaact gtcgcagtgc ttaatgagtt aaagtctgaa
481 gggaaaattc gcgctatagg cgctgctaac gtcgatgctg accatatccg cgagtatctg
541 caatatggtg aactggatat tattcaggcg aaatacagta tcctcgaccg ggcaatggaa
601 aacgaactgc tgccactatg tcgtgataat ggcattgtgg ttcaggttta ttccccgcta
661 gagcagggat tgttgaccgg caccatcact cgtgattacg ttccgggcgg cgctcgggca
721 aataaagtct ggttccagcg tgaaaacatg ctgaaagtga ttgatatgct tgaacagtgg
781 cagccacttt gtgctcgtta tcagtgcaca attcccactc tggcactggc gtggatatta
841 aaacagagtg atttaatctc cattcttagt ggggctactg caccggaaca ggtacgcgaa
901 aatgtcgcgg cactgaatat caacttatcg gatgcagacg caacattgat gagggaaatg
961 gcagaggccc tggagcgtta a
```

Amino acid sequence (SEQ ID NO:142)

```
  1 mkkiplgttd itlsrmglgt waigggpawn gdldrqicid tileahrcgi nlidtapgyn
 61 fgnsevivgq alkklpreqv vvetkcgivw erkgslfnkv gdrqlyknls pesireevaa
121 slqrlgidyi diymthwqsv ppfftpiaet vavlnelkse gkiraigaan vdadhireyl
181 qygeldiiqa kysildrame nellplcrdn givvqvyspl eqglltgtit rdyvpggara
241 nkvwfqrenm lkvidmleqw qplcaryqct iptlalawil kqsdlisils gatapeqvre
301 nvaalninls dadatlmrem aealer
```

YeaE (NP 416295)

Nucleotide sequence (SEQ ID NO:143)

```
  1 atgcaacaaa aaatgattca atttagtggc gatgtctcac tgccagccgt agggcaggga
 61 acatggtata tgggcgaaga tgccagtcag cgcaaaacag aagttgctgc actacgcgcg
121 ggcattgaac tcggtttaac cctcattgat accgccgaaa tgtatgccga tggcggtgcc
181 gaaaaggtgg ttggggaagc attaaccggt ctgcgagaga aggtctttct cgtctctaaa
241 gtctatccgt ggaatgctgg cgggcaaaaa gcgataaatg catgcgaagc cagtttacgc
301 cgtctcaata ctgattatct cgatctttac ttattacact ggtctggcag tttcgctttt
361 gaagagactg tcgcagcgat ggaaaaattg atcgcccagg aaaaatccg ccgctggggc
421 gtttctaacc ttgattatgc tgatatgcag gaactctggc agctgccggg gggaaatcag
481 tgtgccacta atcaggtgct ttaccatctc ggttcacgag gaattgagta cgatctactc
541 ccctggtgcc agcaacagca gatgccggtg atggcttaca gtccgttagc ccaggccggg
601 cggttcgcgca atggactgtt aaaaaacgcg gtagtcaacg aaattgcaca tgctcacaat
661 atcagcgcgg cacaagtatt gttggcgtgg gtgatcagtc atcagggtgt gatggcgatt
721 ccaaaagcgg ccacgattgc ccatgtccaa caaaatgcgg ctgtgcttga ggtcgaactt
781 tcttcagcgg aattagctat gctggataag gcatatccgg caccaaaagg aaaaactgcg
841 ctggatatgg tgtga
```

FIG. 10P

Amino acid sequence (SEQ ID NO:144)
```
  1 mqqkmiqfsg dvslpavgqg twymgedasq rktevaalra gielgltlid taemyadgga
 61 ekvvgealtg lrekvflvsk vypwnaggqk ainaceaslr rlntdyldly llhwsgsfaf
121 eetvaamekl iaqgkirrwg vsnldyadmq elwqlpggnq catnqvlyhl gsrgieydll
181 pwcqqqqmpv maysplaqag rlrngllkna vvneiahahn isaaqvllaw vishqgvmai
241 pkaatiahvq qnaavlevel ssaelamldk aypapkgkta ldmv
``` dkgA (NP_417485)

Nucleotide sequence (SEQ ID NO:145)
```
  1 atggctaatc aaccgttat taagctacag gatggcaatg tcatgcccca gctgggactg
 61 ggcgtctggc aagcaagtaa tgaggaagta atcaccgcca ttcaaaaagc gttagaagtg
121 ggttatcgct cgattgatac cgccgcggcc tacaagaacg aagaaggtgt cggcaaagcc
181 ctgaaaaatg cctcagtcaa cagagaagaa ctgttcatca ccactaagct gtggaacgac
241 gaccacaagc gccccgcga gccctgctc gacagcctga aaaactcca gcttgattat
301 atcgacctct acttaatgca ctggcccgtt ccgctatcg accattatgt cgaagcatgg
361 aaaggcatga tcgaattgca aaaagaggga ttaatcaaaa gcatcggcgt gtgcaacttc
421 cagatccatc acctgcaacg cctgattgat gaaactggcg tgacgcctgt gataaaccag
481 atcgaacttc atccgctgat gcaacaacgc cagctacacg cctggaacgc gacacacaaa
541 atccagaccg aatcctggag cccattagcg caaggaggga aaggcgtttt cgatcagaaa
601 gtcattcgcg atctggcaga taaatacggc aaaacccccgg cgcagattgt tatccgctgg
661 catctggata gcggcctggt ggtgatcccg aaatcggtca cacttcacg tattgccgaa
721 aactttgatg tctgggattt ccgtctcgac aaagacgaac tcggcgaaat tgcaaaactc
781 gatcagggca agcgtctcgg tcccgatcct gaccagttcg gcggctaa
```

Amino acid sequence (SEQ ID NO:146)
```
  1 manptviklq dgnvmpqlgl gvwqasneev itaiqkalev gyrsidtaaa ykneegvgka
 61 lknasvnree lfittklwnd dhkrpreall dslkklqldy idlylmhwpv paidhyveaw
121 kgmielqkeg liksigvcnf qihhlqrlid etgvtpvinq ielhplmqqr qlhawnathk
181 iqteswspla qggkgvfdqk virdladkyg ktpaqivirw hldsglvvip ksvtpsriae
241 nfdvwdfrld kdelgeiakl dqgkrlgpdp dqfgg
```

YajO (NP_414953)

Nucleotide sequence (SEQ ID NO:147)
```
  1 atgcaataca accccttagg aaaaaccgac cttcgcgttt cccgactttg cctcggctgt
 61 atgacctttg gcgagccaga tcgcggtaat cacgcatgga cactgccgga agaaagcagc
121 cgtcccataa ttaaacgtgc actggaaggc ggcataaatt tctttgatac cgccaacagt
181 tattctgacg gcagcagcga agagatcgtc ggtcgcgcac tgcgggattt cgcccgtcgt
241 gaagacgtgg tcgttgcgac caaagtgttc catcgcgttg gtgatttacc ggaaggatta
301 tcccgtgcgc aaattttgcg ctctatcgac gacagcctgc gacgtctcgg catggattat
361 gtcgatatcc tgcaaattca tcgctgggat tacaacacgc cgatcgaaga gacgctggaa
421 gccctcaacg acgtggtaaa agccgggaaa gcgcgttata tcggcgcgtc atcaatgcac
481 gcttcgcagt ttgctcaggc actggaactc caaaaacagc acggctgggc gcagtttgtc
541 agtatgcagg atcactacaa tctgatttat cgtgaagaag agcgcgagat gctaccactg
601 tgttatcagg agggcgtggc ggtaattcca tggagcccgc tggcaagggg ccgtctgacg
661 cgtccgtggg gagaaactac cgcacgactg gtgtctgatg aggtgggaa aaatctctat
721 aaagaaagcg atgaaatga cgcgcagatc gcagagcggt aacaggcgt cagtgaagaa
781 ctgggggcga cacgagcaca agttgcgctg gcctggttgt tgagtaaacc gggcattgcc
841 gcaccgatta tcggaacttc gcgcgaagaa cagcttgatg agctattgaa cgcggtggat
901 atcactttga gccggaaca gattgccgaa ctggaaacgc cgtataaacc gcatcctgtc
961 gtaggattta aataa
```

Amino acid sequence (SEQ ID NO:148)
```
  1 mqynplgktd lrvsrlclgc mtfgepdrgn hawtlpeess rpiikraleg ginffdtans
 61 ysdgsseeiv gralrdfarr edvvvatkvf hrvgdlpegl sraqilrsid dslrrlgmdy
121 vdilqihrwd yntpieetle alndvvkagk aryigassmh asqfaqalel qkqhgwaqfv
181 smqdhynliy reeeremlpl cyqegvavip wsplargrlt rpwgettarl vsdevgknly
```

FIG. 10Q

```
241 kesdendaqi aerltgvsee lgatraqval awllskpgia apiigtsree qldellnavd
301 itlkpeqiae letpykphpv vgfk
```

YghZ (NP_417474)

Nucleotide sequence (SEQ ID NO:149)

```
   1 atggtctggt tagcgaatcc cgaacgttac gggcagatgc aataccgcta ttgcggaaaa
  61 agtggtttac gcctgcccgc gttatcgctc ggtttatggc acaatttcgg tcacgttaac
 121 gcgctggaat cacagcgtgc gatcctgcgt aaagcgtttg atttgggcat tacgcacttt
 181 gatttagcca acaattacgg gccgtcccca ggaagcgcag aagagaactt tggtcgcctg
 241 ctgcgggagg attttgccgc ttatcgcgat gaactgatta tctctaccaa ggctggctac
 301 gatatgtggc ccggcccta cggctctggc ggttcacgta aatacctgct cgccagcctc
 361 gaccaaagcc tgaagcgtat ggggcttgag tatgtcgata tcttttactc tcatcgcgtc
 421 gatgaaaata cgccgatgga agaaaccgcc tctgcgctgg ctcatgcggt acaaagcggt
 481 aaggcgctgt atgtcgggat ctcctcttac tcgccagagc ggacgcaaaa aatggtcgag
 541 ttgctgcgcg agtggaaaat tccgctgtta attcatcaac cttcgtacaa tttactgaac
 601 cgctgggtgg ataaaagcgg cctgctggat accctgcaaa ataacggcgt gggctgtatt
 661 gcctttactc ctctggctca gggattgctg accggaaaat atctcaacgg cattccgcaa
 721 gattcacgga tgcatcgtga agggaataaa gttcgtggtc tgacaccgaa aatgcttacc
 781 gaagccaacc tcaacagcct gcgcttattg aatgaaatgg cacagcagcg tggacaatca
 841 atggcgcaaa tggcgttaag ctggttgctg aaagatgatc gcgtgacgtc ggtattgatt
 901 ggtgccagcc gcgcggagca actagaggag aacgtgcagg cgctgaataa tctgacattt
 961 agcaccaagg agctggcgca gattgatcag catatcgccg atggcgagct gaatctgtgg
1021 caggcgtctt ccgataaatg a
```

Amino acid sequence (SEQ ID NO:150)

```
   1 mvwlanpery gqmqyrycgk sglrlpalsl glwhnfghvn alesqrailr kafdlgithf
  61 dlannygppp gsaeenfgrl lredfaayrd eliistkagy dmwpgpygsg gsrkyllasl
 121 dqslkrmgle yvdifyshrv dentpmeeta salahavqsg kalyvgissy spertqkmve
 181 llrewkipll ihqpsynlln rwvdksglld tlqnngvgci aftplaqgll tgkylngipq
 241 dsrmhregnk vrgltpkmlt eanlnslrll nemaqqrgqs maqmalswll kddrvtsvli
 301 gasraeqlee nvqalnnltf stkelaqidq hiadgelnlw qassdk
```

Tas (NP_417311)

(Nucleotide sequence (SEQ ID NO:151)

```
   1 atgcaatatc accgtatacc ccacagttcg ctggaagtca gcacgctggg gcttggcacg
  61 atgacgtttg gtgaacagaa cagcgaagcc gacgcccacg cacaactcga ctatgccgtc
 121 gctcagggca ttaaccttat cgacgttgcc gaaatgtacc cagtacctcc gcgccccgaa
 181 acgcaagggt taaccgaaac ctacgtcggc aactggctgg cgaaacatgg cagccgcgaa
 241 aagttaatta tcgcctccaa agtgagcgga ccgtcgcgca ataatgacaa gggcatccgc
 301 ccggatcagg cgctggatcg gaagaatatc cgcaagcgc tgcatgacag cctcaagcgc
 361 ctacagactg attacctcga tctttatcag gtgcactggc cgcagcgccc gaccaactgc
 421 ttcggcaaac tcggttatag ctggacggat tctgcgcctg cggtttcgct gctggatacg
 481 ctggacgcac tggcagagta ccaacgcgcg ggaaaaattc gttatatcgg cgtgtcgaac
 541 gaaactgcat ttggcgtaat gcgctacctg catctggcgg acaaacacga tctgccgcgt
 601 attgtcacca ttcagaaccc ttacagtctg ttaaaccgca gttttgaagt aggtctggca
 661 gaagtcagcc agtatgaagg ggtcgaactg ctggcctatc gtgcctgggt tttcggcacg
 721 ctgaccggga aatatctcaa tggtgcaaaa cccgctggcg cacgtaatac gctctttagt
 781 cggttcaccc gctatagcgg tgagcaaacg caaaaagcct cgcggcgta tgttgatatc
 841 gccagacgtc atggcctgga ccctgctcag atggcgctcg cgtttgtacg ccgtcaaccg
 901 tttgttgcca gcactctgct gggcgcaacc acgatggatc agctgaaaac taacatcgaa
 961 agtttgcatc tggagttaag cgaagacgta ttagctgaaa ttgaagcggt gcatcaggtt
1021 tatacttatc cggcaccata a
```

Amino acid sequence (SEQ ID NO:152)

```
   1 mqyhriphss levstlglgt mtfgeqnsea dahaqldyav aqginlidva emypvpprpe
  61 tqgltetyvg nwlakhgsre kliiaskvsg psrnndkgir pdqaldrkni realhdslkr
 121 lqtdyldlyq vhwpqrptnc fgklgyswtd sapavslldt ldalaeyqra gkiryigvsn
```

FIG. 10R

```
181 etafgvmryl hladkhdlpr ivtiqnpysl lnrsfevgla evsqyegvel laysclgfgt
241 ltgkylngak pagarntlfs rftrysgeqt qkavaayvdi arrhgldpaq malafvrrqp
301 fvastllgat tmdqlktnie slhlelsedv laeieavhqv ytypap
```

YdhF (YP 025305)

Nucleotide sequence (SEQ ID NO:153)

```
  1 atggttcagc gtattactat tgcgccgcaa ggcccggagt tttcccgttt tgtgatgggc
 61 tactggcgat tgatggactg gaatatgtcc gcccgccagc tggtcagttt tattgaagag
121 catctggatc tcggcgtgac caccgtggac catgctgata tttatggtgg ctatcagtgc
181 gaagcggcgt ttggcgaggc actgaaactg gcacctcacc tgcgtgaacg gatggaaatc
241 gtcagtaaat gcggtatcgc gacgaccgcg cgtgaagaaa acgtcattgg tcattacatc
301 actgaccgcg atcacatcat taagagcgcc gaacagtcgc taattaatct cgcgaccgat
361 catctggatt tgctgttaat ccaccgacca gacccgttaa tggatgccga tgaagtggcg
421 gacgcgttca acatctgca tcagagcggc aaagtgcgtc attttggcgt atcgaacttt
481 acgcctgcgc aatttgccct gttgcaatca cgtctgccgt ttaccttgc cactaatcag
541 gtggaaatat ccccggtgca tcagccgtta ctgctggatg gcacgctcga ccaactacaa
601 caactcgtg ttccgat ggcgtggtcc tgccttggtg gtggtcgtct gtttaatgat
661 gattatttcc agccgctgcg tgatgaactg gctgtgttga cagaggagtt aaacgcgggc
721 tcgattgaac aggtggttta cgcctgggta ttacgtttac catcgcagcc gctgccaatt
781 atcggttcag gtaaaattga gcgcgtacgg gcagctgtcg aagcagaaac actgaaaatg
841 acccgtcaac aatggtttcg tatccgtaaa gcggcactgg ggtacgacgt accgtaa
```

Amino acid sequence (SEQ ID NO:154)

```
  1 mvqritiapq gpefsrfvmg ywrlmdwnms arqlvsfiee hldlgvttvd hadiyggyqc
 61 eaafgealkl aphlrermei vskcgiatta reenvighyi tdrdhiiksa eqslinlatd
121 hldlllihrp dplmdadeva dafkhlhqsg kvrhfgvsnf tpaqfallqs rlpftlatnq
181 veispvhqpl lldgtldqlq qlrvrpmaws clgggrlfnd dyfqplrdel avvaeelnag
241 sieqvvyawv lrlpsqplpi igsgkiervr aaveaetlkm trqqwfrirk aalgydvp
```

YdbC (NP 415924)

Nucleotide sequence (SEQ ID NO:155)

```
  1 atgagcagca atacatttac tctcggtaca aaatccgtta accgtcttgg ttatggcgcg
 61 atgcaactgg caggtcctgg agtttttggc ccccacgag atcgccacgt cgctataacc
121 gtgctgcgtg aggcgctggc attgggcgtc aatcatattg ataccagcga cttttatggt
181 ccgcacgtca ccaatcagat tatccgcgaa gcgctttatc cttactctga cgacctgaca
241 attgtcacta aaattggtgc gcggcgtgga gaggacgcat cctggttgcc cgcatttctc
301 ccggcagagc tgcaaaaagc ggtgcacgat aatctacgta atctcgggct ggacgtgctg
361 gatgtggtta acctgcgcgt tatgatgggg gatggtcatg cccagcgga aggatcgatt
421 gaggccagcc tgaccgtgct ggcagagatg caacaacaag gcctggtaaa acatattggc
481 ctgagcaacg tcacaccgac gcaggttgca gaggcgcgca agattgccga aattgtctgt
541 gtgcaaaacg aatacaacat cgcgcaccgt gctgatgatg caatgattga tgctttggcc
601 cacgatggca ttgcctacgt gccgttcttc ccgctcgggg ctttacacc gctgcaatcg
661 tccacacttt ccgatgttgc tgcgagcctg ggtgcaacac caatgcaggt ggcgctggcg
721 tggctgttac agcgttcacc gaatattttg ctgatcccag ggacgtcttc ggttgcgcat
781 ttacgggaga atatggctgc tgaaaaattg catctttctg aggaagtgtt gtctacgttg
841 gatggtattt cgcgagaata a
```

Amino acid sequence (SEQ ID NO:156)

```
  1 mssntftlgt ksvnrlgyga mqlagpgvfg pprdrhvait vlrealalgv nhidtsdfyg
 61 phvtnqiire alypysddlt ivtkigarrg edaswlpafs paelqkavhd nlrnlgldvl
121 dvvnlrvmmg dghgpaegsi easltvlaem qqqglvkhig lsnvtptqva earkiaeivc
181 vqneyniahr addamidala hdgiayvpff plggftplqs stlsdvaasl gatpmqvala
241 wllqrspnil lipgtssvah lrenmaaekl hlseevlstl dgisre
```

FIG. 10S ybbO (NP 415026)

Nucleotide sequence (SEQ ID NO:157)
```
  1 atgactcata aagcaacgga gatcctgaca ggtaaagtta tgcaaaaatc ggtcttaatt
 61 accggatgtt ccagtggaat tggcctggaa agcgcgctcg aattaaaacg ccagggtttt
121 catgtgctgg caggttgccg gaaaccggat gatgttgagc gcatgaacag catgggattt
181 accggcgtgt tgatcgatct ggattcacca gaaagtgttg atcgcgcagc cgacgaggtg
241 atcgccctga ccgataattg tctgtatggg atctttaaca atgccggatt cggcatgtat
301 ggcccccttt ccaccatcag ccgtgcgcag atggaacagc agttttccgc caacttttc
361 ggcgcacacc agctcaccat gcgcctgtta ccgcgatgt taccgcacgg tgaagggcgt
421 attgtgatga catcatcggt gatgggatta atctccacgc cgggtcgtgg cgcttacgcg
481 gccagtaaat atgcgctgga ggcgtggtca gatgcactgc gcatggagct gcgccacagc
541 ggaattaaag tcagcctgat cgaacccggt cccattcgta ctcgcttcac cgacaacgtc
601 aaccagacgc aaagtgataa accagtcgaa atcccggca tcgccgcccg ctttacgttg
661 ggaccggaag cggtggtgga caaagtacgc catgctttta ttagcgagaa gccgaagatg
721 cgctatccgg tgacgctggt gacctgggcg gtaatggtgc ttaagcgcct gctgccgggg
781 cgcgtgatgg acaaaatatt gcaggggtga
```

Amino acid sequence (SEQ ID NO:158)
```
  1 mthkateilt gkvmqksvli tgcssgigle salelkrqgf hvlagcrkpd dvermnsmgf
 61 tgvlidldsp esvdraadev ialtdnclyg ifnnagfgmy gplstisraq meqqfsanff
121 gahqltmrll pamlphgegr ivmtssvmgl istpgrgaya askyaleaws dalrmelrhs
181 gikvsliepg pirtrftdnv nqtqsdkpve npgiaarftl gpeavvdkvr hafisekpkm
241 rypvtlvtwa vmvlkrllpg rvmdkilqg
``` yohF (NP 416641)

Nucleotide sequence (SEQ ID NO:159)
```
  1 atggcacagg ttgcgattat taccgcctcc gattcgggga tcggcaaaga gtgcgcgtta
 61 ttactggcgc agcaggggtt tgatattggt attacctggc actcagatga agaaggggca
121 aaagataccg cgcgtgaggt agttagccac ggcgtacgtg cggagatcgt gcagctggat
181 ctcggcaatc taccagaagg ggcactggcg ctggagaaac tcattcaacg gctgggcgc
241 attgatgtgc tggtgaataa tgcgggtgca atgaccaaag cgccgttct tgatatggct
301 tttgatgagt ggcgcaagat ttttaccgtt gatgtcgatg gtgcattctt atgctcgcaa
361 attgcggctc gtcagatggt gaaacaaggg cagggcggtc gcatcatcaa cattacgtcg
421 gtacatgaac atacgccgct gccggatgcc agcgcctaca cagccgctaa acatgcgctc
481 ggtgggttaa ccaaagcgat ggcgctggag ctggtcaggc ataagatttt ggtgaacgca
541 gtcgcgcctg gggcgatcgc cacgccaatg aatggcatgg atgacagcga cgtgaagccc
601 gacgcggagc cttcgattcc cttgcggcgt tttggcgcaa cgcatgagat tgccagcctg
661 gtggtgtggc tttgttcgga gggcgcaaat tacaccaccg ggcagtcgtt gatagtggat
721 ggcggcttta tgttggcgaa tccacagttc aacccagaat ag
```

Amino acid sequence (SEQ ID NO:160)
```
  1 maqvaiitas dsgikecal llaqqgfdig itwhsdeega kdtarevvsh gvraeivqld
 61 lgnlpegala lekliqrlgr idvlvnnaga mtkapfldma fdewrkiftv dvdgaflcsq
121 iaarqmvkqg qggriiinits vhehtplpda saytaakhal ggltkamale lvrhkilvna
181 vapgaiatpm ngmddsdvkp daepsiplrr fgatheiasl vvwlcsegan yttgqslivd
241 ggfmlanpqf npe
```

YciK (NP 415787)

Nucleotide sequence (SEQ ID NO:161)
```
  1 atgcattacc agccaaaaca agatttactc aatgatcgca ttatcctggt gacgggagcc
 61 agcgatggta ttggtcgtga agccgcgatg acgtatgcac gctatggtgc gacagtgatt
121 ctgttgggcc gtaatgaaga aaaattacgt caggtagcca gccacataaa cgaagaaact
181 gggcgtcagc cacagtggtt tattctcgat ttgctgacct gcacgtccga aaattgccaa
241 caactggcac agcgcattgc cgttaattat ccgcgtctgg atggtgtttt gcataatgcc
301 ggattgctcg gcgatgtttg cccaatgagc gaacaaaatc cgcaggtctg caggacgtc
361 atgcaggtca acgttaatgc caccttttatg ctcacccagg cactgcttcc tttattactc
```

FIG. 10T

```
421 aaatcggacg ccggttcact ggtctttact tcatcaagcg ttggacgtca gggacgagcc
481 aactggggtg catatgcagc gtcgaaattt gccaccgaag ggatgatgca ggtactggcc
541 gatgaatatc agcagcgcct gcgtgtcaac tgcattaacc caggcggtac gcgcaccgca
601 atgcgtgcca cgcgcttccc gaccgaagat ccacagaaac ttaaaacacc cgctgatatc
661 atgccgctct acctctggct gatgggcgat gacagccgcc gtaaaaccgg catgaccttt
721 gacgcccaac cgggccgtaa accaggaatt tcccaatga
```

Amino acid sequence (SEQ ID NO:162)

```
  1 mhyqpkqdll ndriilvtga sdgigreaam tyarygatvi llgrneeklr qvashineet
 61 grqpqwfild lltctsencq qlaqriavny prldgvlhna gllgdvcpms eqnpqvwqdv
121 mqvnvnatfm ltqallplll ksdagslvft sssvgrqgra nwgayaaskf ategmmqvla
181 deyqqrlrvn cinpggtrta mrasafpted pqklktpadi mplylwlmgd dsrrktgmtf
241 daqpgrkpgi sq
```

YgfF (NP 417378)

Nucleotide sequence (SEQ ID NO:163)

```
  1 atggctatag cacttgtgac tggtggcagt cgcggcatcg ggcgggcaac tgcattactg
 61 ttggcgcaag aagggtatac ggtggcggtt aattatcagc aaaacctcca cgcggcgcag
121 gaagtgatga acttaataac gcaagccggt ggcaaagcat tcgtgctcca ggcggatatc
181 agcgacgaaa accaggtcgt tgcgatgttt acagcaatcg atcagcacga tgaaccgcta
241 gcagcgctgg tcaataacgc cgggatcttg tttacccagt gcaccgttga aaaccttacc
301 gcagagcgaa tcaaccgagt actttccacc aacgtgacgg gatatttttct ctgctgccgc
361 gaggcggtaa aacgcatggc gcttaaaaat ggtggcagtg gcggcgctat cgtcaatgtc
421 tcttcggtgg cctcacggtt gggttcgcca ggggaatatg ttgattacgc ggcatcgaaa
481 ggggcgattg atacgttaac caccggacta tcgctggaag tcgccgcgca ggggatccgc
541 gttaactgcg tgcggccagg gtttatttat accgaaatgc acgccagcgg cggcgagcct
601 ggacgcgtcg atcgcgttaa gtcgaacatc cccatgcagc gtggtggaca ggcagaagag
661 gtcgcgcagg ccattgtctg gctactaagt gataaagcct cttacgtcac gggaagtttt
721 atcgatttgg cgggcgggaa ataa
```

Amino acid sequence (SEQ ID NO:164)

```
  1 maialvtggs rgigratall laqegytvav nyqqnlhaaq evmnlitqag gkafvlqadi
 61 sdenqvvamf taidqhdepl aalvnnagil ftqctvenlt aerinrvlst nvtgyflccr
121 eavkrmalkn ggsggaivnv ssvasrlgsp geyvdyaask gaidtlttgl slevaaqgir
181 vncvrpgfiy temhasggep grvdrvksni pmqrggqaee vaqaivwlls dkasyvtgsf
241 idlaggk
```

YghA (NP 417476)

Nucleotide sequence (SEQ ID NO:165)

```
  1 atgtctcatt taaaagaccc gaccacgcag tattacactg gtgaatatcc caaacagaaa
 61 caaccgacgc caggcatcca ggcgaagatg acaccggtac cggattgcgg cgagaaaacc
121 tatgttggta gcggtcgcct gaaagatcgt aaagcactgg tgacaggggg cgattccgga
181 ataggtcgcg ctgccgccat cgcttacgcg cgtgaagggg ctgacgtggc gatcagttat
241 cttcccgtgg aagaagaaga cgctcaggat gtgaaaaaga tcattgaaga atgcggacgc
301 aaagccgttc tgctgccagg cgatttaagc gatgagaaat tgcccgttc gctggttcac
361 gaagcgcaca aggcgttagg cgggctggat attatggcgc tggtcgccgg gaaacaggtt
421 gccattccgg atattgcaga cctcaccagc gaacagtttc aaaagacctt tgccattaac
481 gttttcgcgc tgttctggct aaacccaggaa gcgatccccc tgctaccgaa aggtgcaagt
541 atcatcacca cttcgtcaat ccaggcatac cagccaagtc gcatttact ggactatgcg
601 gctacgaagg cggcgattct gaactacagc cgtggcttgg caaacaggt cgcggagaaa
661 ggtattcggg tgaatattgt cgcgccaggc ccgatctgga cagcactgca aatttccggc
721 ggacaaacgc aggataagat cccgcagttt ggtcagcaaa cgccgatgaa acgtgcgggg
781 caaccggcgg aactggcccc tgtatatgtt tatctggcaa gtcaggagtc gagctacgtc
841 accgcagaag tgcacggcgt gtgcggcggc gagcatttag gttaa
```

Amino acid sequence (SEQ ID NO:166)

```
  1 mshlkdpttq yytgeypkqk qptpgiqakm tpvpdcgekt yvgsgrlkdr kalvtggdsg
```

FIG. 10U

```
 61 igraaaiaya regadvaisy lpveeedaqd vkkiieecgr kavllpgdls dekfarslvh
121 eahkalggld imalvagkqv aipdiadlts eqfqktfain vfalfwltqe aipllpkgas
181 iittssiqay qpsphlldya atkaailnys rglakqvaek girvnivapg piwtalqisg
241 gqtqdkipqf gqqtpmkrag qpaelapvyv ylasqessyv taevhgvcgg ehlg
```

YjgI (NP_418670)

Nucleotide sequence (SEQ ID NO:167)

```
  1 atgggcgctt ttacaggtaa gacagttctc atcctcggtg gcagtcgtgg tatcggtgcc
 61 gctatcgtac gtcgtttcgt caccgatggg gccaatgtac gattcaccta tgcggggtcg
121 aaagatgccg ctaaacgcct ggcacaagag actggagcga cagcagtatt cacagatagt
181 gctgacagag acgctgtcat tgatgtcgtt cgtaagagcg gcgcattgga tatcctggtg
241 gtaaatgcag gtattggcgt ctttggcgag gccctggaat taaatgccga cgatattgat
301 cgccttttca aaatcaatat tcatgctcct tatcatgcct ctgttgaagc cgcccggcag
361 atgcccgaag cggggcgcat cttaatcatc ggctccgtga atggcgatcg tatgcctgtt
421 gcaggcatgg ctgcttatgc cgccagcaaa tctgccctgc aaggcatggc gcgcgggctg
481 gcccgtgatt ttggaccgcg tgggatcacc attaacgtcg tccagccagg gccaattgat
541 accgacgcta atcccgccaa cgggccaatg cgcgatatgt tgcatagttt gatggctatc
601 aaaagacatg ggcaaccgga agaggtcgct ggtatggtcg catggttagc agggccagaa
661 gccagttttg ttaccggcgc gatgcatacc attgatggcg cgtttggcgc ataa
```

Amino acid sequence (SEQ ID NO:168)

```
  1 mgaftgktvl ilggsrgiga aivrrfvtdg anvrftyags kdaakrlaqe tgatavftds
 61 adrdavidvv rksgaldilv vnagigvfge alelnaddid rlfkinihap yhasveaarq
121 mpeggrilii gsvngdrmpv agmaayaask salqgmargl ardfgprgit invvqpgpid
181 tdanpangpm rdmlhslmai krhgqpeeva gmvawlagpe asfvtgamht idgafga
```

YdfG (NP_416057)

Nucleotide sequence (SEQ ID NO:169)

```
  1 atgatcgttt tagtaactgg agcaacggca ggttttggtg aatgcattac tcgtcgtttt
 61 attcaacaag ggcataaagt tatcgccact ggccgtcgcc aggaacggtt gcaggagtta
121 aaagacgaac tgggagataa tctgtatatc gcccaactgg acgttcgcaa ccgcgccgct
181 attgaagaga tgctggcatc gcttcctgcc gagtggtgca atattgatat cctggtaaat
241 aatgccggcc tggcgttggg catggagcct gcgcataaag ccagcgttga agactgggaa
301 acgatgattg ataccaacaa caaaggcctg gtatatatga cgcgcgccgt cttaccgggt
361 atggttgaac gtaatcatgg tcatattatt aacattggct caacggcagg tagctggccg
421 tatgccggtg gtaacgttta cggtgcgacg aaaagcgttt ttcgtcagtt tagcctgaat
481 ctgcgtacgg atctgcatgg tacggcgGTg cgcgtcacgg acatcgaacc gggtctggtg
541 ggtggtaccg agttttccaa tgtccgcttt aaaggcgatg acggtaaagc agaaaaaacc
601 tatcaaaata ccgttgcatt gacgccagaa gatgtcagcg aagccgtctg gtgggtgtca
661 acgctgcctg ctcacgtcaa tatcaatacc ctggaaatga tgccggttac ccaaagctat
721 gccggactga atgtccaccg tcagtaa
```

Amino acid sequence (SEQ ID NO:170)

```
  1 mivlvtgata gfgecitrrf iqqghkviat grrqerlqel kdelgdnlyi aqldvrnraa
 61 ieemlaslpa ewcnidilvn naglalgmep ahkasvedwe tmidtnnkgl vymtravlpg
121 mvernhghii nigstagswp yaggnvygat kafvrqfsln lrtdlhgtav rvtdiepglv
181 ggtefsnvrf kgddgkaekt yqntvaltpe dvseavwwvs tlpahvnint lemmpvtqsy
241 aglnvhrq
```

YgcW (NP_417254)

Nucleotide sequence (SEQ ID NO:171)

```
  1 atgtcaatcg aatctctcaa tgcgttctca atggattttt tctccctgaa aggtaaaacc
 61 gcaattgtta ccggtgggaa tagcggttta ggccaggcat ttgccatggc gttggccaaa
121 gctggcgcaa atatctttat tcctagtttc gtcaaagata acggcgaaac aaaggaaatg
181 attgaaaaac agggtgttga ggtggacttc atgcaggtgg tatcaccgc agaaggcgcg
```

FIG. 10V

```
    241 ccgcagaaga ttatcgctgc ttgctgtgag cgtttcggta cagttgatat tctggttaac
    301 aatgccggta tttgtaagct gaataaggtg ctggacttcg gtcgtgccga ctgggatccg
    361 atgattgatg tgaacctgac cgccgcattc gagttaagct atgaagctgc aaaaattatg
    421 atcccgcaga aaagcggcaa aattattaat atctgttcat tgttctctta cttaggtgga
    481 caatggtcac ctgcatattc tgccactaaa catgctcttg ccgggttcac caaagcttat
    541 tgtgatgaac taggtcaata taatattcag gtaaatggta tcgcccctgg ctattatgca
    601 acagatatta cgctggcgac acgcagtaat ccagaaacca atcagcgcgt tcttgatcat
    661 attccggcaa accgttgggg cgatactcag gatttaatgg gcgcagccgt attcctcgca
    721 agtccggcat cgaattatgt caacgggcat ttattagtgg ttgatggcgg ttatttagtg
    781 cgctaa
```

Amino acid sequence (SEQ ID NO:172)

```
      1 msieslnafs mdffslkgkt aivtggnsgl gqafamalak aganifipsf vkdngetkem
     61 iekqgvevdf mqvgitaega pqkiiaacce rfgtvdilvn nagicklnkv ldfgradwdp
    121 midvnltaaf elsyeaakim ipqksgkiin icslfsylgg qwspaysatk halagftkay
    181 cdelgqyniq vngiapgyya tditlatrsn petnqrvldh ipanrwgdtq dlmgaavfla
    241 spasnyvngh llvvdggylv r
```

UcpA (NP_416921)

Nucleotide sequence (SEQ ID NO:173)

```
      1 tcagataccg acgctaaccg tctccggcag tgtgctgccg ccatcaatca cattctgtgt
     61 accggttaaa tagctggatt catccgatgc gaggaaggcc gccagttcgc cgacttccag
    121 cggatcggcg aggcgacgca tcgggattgc tttcgccatt tcagtcagca ccgactctgg
    181 atcttccggg ttcgactggc gggcaatgct ttccgccatt ggtgtgcgca cgtatcccgg
    241 gcaaatggcg ttaacgcgaa taccagactg cgcgtactcc accgccagcg attttgtcag
    301 gccaacaatc gccgctttcg ttaaggcgta cgccgtttcg ccaggatcgg ccaccatatc
    361 accagtgact gaagacatca tcacaatgcg accatctttg cgggcaatca tctccggcag
    421 caccgccttc gtgacgttcc atacgccttt aatattgatg tcaatatgga aatcgcgatc
    481 gtcatcgctc atatcgagga aactgcccag cgacaaacg cctgcgttat tcaccaggat
    541 atcaatgcgc ccttcttttt ccttcgcgcg tttgatagct gcggctaccg acgccgggtc
    601 acgcacatcg gcgacaaccg ccgtacagcg atgaccacga ccacacagtt cgtccgccag
    661 cttttcgatc tcagggaga tatccagcaa gattaggttc gcgccatgac gtgcaaaagt
    721 tctggcaatt ccttcgccaa ttccctgcaa tgcgcccgta atcagtgctg tcttgcccgt
    781 gagtttaccc at
```

Amino acid sequence (SEQ ID NO:174)

```
      1 mgkltgktal itgalqgige giartfarhg anlillldisp eiekladelc grghrctavv
     61 advrdpasva aaikrakeke gridilvnna gvcrlgsfld msdddrdfhi dinikgvwnv
    121 tkavlpemia rkdgrivmms svtgdmvadp getayaltka aivgltksla veyaqsgirv
    181 naicpgyvrt pmaesiarqs npedpesvlt emakaipmrr ladplevgel aaflasdess
    241 yltgtqnvid ggstlpetvs vgi
```

EntA (NP_415128)

Nucleotide sequence (SEQ ID NO:175)

```
      1 atggatttca gcggtaaaaa tgtctgggta accggcgcag gtaaaggtat cggctacgcc
     61 acggcgctgg cgtttgttga ggcgggagcg aaagttacag gttttgatca agcgttcact
    121 caggagcaat atcccttgc gaccgaagtg atggatgttg ccgacgctgc gcaggtcgcg
    181 caagtgtgtc agcgactgtt agctgaaacg gagcgactgg acgcgctggt caatgcggcg
    241 ggaattttac gcatgggcgc gaccgatcag ctcagtaaag aggactggca gcagactttt
    301 gcggttaacg tcggcggtgc gtttaacctg ttccagcaaa ccatgaacca gtttcgccgt
    361 cagcggggcg gggcgattgt cactgtggcg tccgacgccg cgcacgcc gcgtattggc
    421 atgagtgctt atggcgcatc gaaagcggcg ctgaaaagcc tggcgttgag cgtcgggctg
    481 gaactggcgg gtagcggcgt gcgctgtaat gtggtttcgc ctggctccac cgacaccgat
    541 atgcaacgca cgctgtgggt gagcgatgac gccgaagaac agcgtattcg cggctttgc
    601 gagcagttta aactcggcat tccgctgggg aaaatcgccc gtccacaaga gatcgccaac
    661 acgatttttgt tcctcgcctc tgacctcgcc agccatatta ccctacagga tattgtggtc
    721 gatggcggct caacgctggg ggcataa
```

FIG. 10W

Amino acid sequence (SEQ ID NO:176)
```
  1 mdfsgknvwv tgagkgigya talafveaga kvtgfdqaft qeqypfatev mdvadaaqva
 61 qvcqrllaet erldalvnaa gilrmgatdq lskedwqqtf avnvggafnl fqqtmnqfrr
121 qrggaivtva sdaahtprig msaygaskaa lkslalsvgl elagsgvrcn vvspgstdtd
181 mqrtlwvsdd aeeqrirgfg eqfklgiplg kiarpqeian tilflasdla shitlqdivv
241 dggstlga
```

FoIM (NP_416123)

Nucleotide sequence (SEQ ID NO:177)
```
  1 atgggtaaaa cccagcccct gccaatatta attactggcg gaggtcgtcg catcggcctc
 61 gccctcgcat ggcatttcat taatcaaaag caaccggtga ttgtcagcta tcggacacac
121 tatccagcca ttgatggact gattaatgca ggtgcgcagt gtattcaggc tgattttcg
181 accaacgacg gtgtgatggc gtttgccgat gaagtactaa aaagcaccca tggtctgcgt
241 gctattttgc ataacgccag tgcgtggatg gcggaaaaac cgggtgcgcc actgccgac
301 gtactggctt gcatgatgca gatccacgtt aatacccat acctgctcaa ccatgcgctg
361 gaaagattac tgcgtgggca cggacgcgcc gccagcgata tcattcactt taccgattat
421 gtggtggagc gcggtagcga caaacatatt gcgtatgctg caagcaaagc ggcactggat
481 aatatgaccc gctcgtttgc ccgcaagctg gcaccggaag tgaaagtgaa ttctattgcg
541 ccatcgctga tcctgtttaa tgaacatgat gatgccgaat atcgacaaca ggcgctgaat
601 aaatcactga tgaaaaccgc gcctggcgag aagaagtga tcgacctggt cgattactta
661 cttaccagtt gctttgtcac cggacgcagt ttcccacttg atggcggtcg tcatctgcgt
721 taa
```

Amino acid sequence (SEQ ID NO:178)
```
  1 mgktqplpil itgggrrigl alawhfinqk qpvivsyrth ypaidglina gaqciqadfs
 61 tndgvmafad evlksthglr ailhnasawm aekpgaplad vlacmmqihv ntpyllnhal
121 erllrghgha asdiihftdy vvergsdkhi ayaaskaald nmtrsfarkl apevkvnsia
181 pslilfnehd daeyrqqaln kslmktapge kevidlvdyl ltscfvtgrs fpldggrhlr
```

HdhA (NP_416136)

Nucleotide sequence (SEQ ID NO:179)
```
  1 gtgtttaatt ctgacaacct gagactcgac ggaaaatgcg ccatcatcac aggtgcgggt
 61 gcaggtattg gtaaagaaat cgccattaca ttcgcgacag ctggcgcatc tgtggtggtc
121 agtgatatta acgccgacgc agctaaccat gttgtagacg aaattcaaca actgggtggt
181 caggcatttg cctgccgttg tgatattact tccgaacagg aactctctgc actggcagac
241 tttgctatca gtaagctggg taaagttgat attctggtta caacgccgg tgcggtgga
301 cctaaaccgt ttgatatgcc aatggcggat tttcgccgt cttatgaact gaatgtgttt
361 tctttttttc catctgtcaca acttgttgcg ccagaaatgg aaaaaatgg cggtggcgtt
421 attctgacca tcacttctat ggcggcagaa aataaaaata taaacatgac ttcctatgca
481 tcatctaaag ctgcggccag tcatctggtc agaaatatga cgtttgacct gggtgaaaaa
541 aatattcggg taaatggcat tgcgccgggg gcaatattaa ccgatgccct gaaatccgtt
601 attacaccgg aaattgaaca aaaaatgtta cagcacacgc cgatcagacg tctgggccaa
661 ccgcaagata ttgctaacgc agcgctgttc ctttgctcgc ctgctgcgag ctgggtaagc
721 ggacaaattc tcaccgtctc cggtggtggg gtacaggagc tcaattaa
```

Amino acid sequence (SEQ ID NO:180)
```
  1 mfnsdnlrld gkcaiitgag agigkeiait fatagasvvv sdinadaanh vvdeiqqlgg
 61 qafacrcdit seqelsalad faisklgkvd ilvnnagggg pkpfdmpmad frrayelnvf
121 sffhlsqlva pemeknggv iltitsmaae nkninmtsya sskaaashlv rnmafdlgek
181 nirvngiapg ailtdalksv itpeieqkml qhtpirrlgq pqdianaalf lcspaaswvs
241 gqiltvsggg vqeln
```

HcaB (NP_417036)

Nucleotide sequence (SEQ ID NO:181)

FIG. 10X

```
  1 atgagcgatc tgcataacga gtccattttt attaccggcg gcggatcggg attagggctg
 61 gcgctggtcg agcgatttat cgaagaaggc gcgcaggttg ccacgctgga actgtcggcg
121 gcaaaagtcg ccagtctgcg tcagcgattt ggcgaacata ttctggcggt ggaaggtaac
181 gtgacctgtt atgccgatta tcaacgcgcg gtcgatcaga tcctgactcg ttccggcaag
241 ctggattgtt ttatcggcaa tgcaggcatc tggatcaca atgcctcact ggttaatact
301 cccgcagaga cgctcgaaac cggcttccac gagctgttta acgtcaatgt tctcggttac
361 ctgctgggcg caaaagcctg cgctccggcg ttaatcgcca gtgaaggcag catgattttc
421 acactgtcaa atgccgcctg gtatcctggc ggcggtggcc cgctgtacac cgccagtaaa
481 catgccgcaa ccggacttat cgccaactg gcttatgaac tggcaccgaa agtgcgggtg
541 aatggcgtcg gcccgtgtgg tatggccagc gacctgcgcg gcccacaggc gctcgggcaa
601 agtgaaacct cgataatgca gtctctgacg ccggagaaaa ttgccgccat tttaccgctg
661 caattttttcc cgcaaccggc ggattttacg gggccgtatg tgatgttgac atcgcggcgc
721 aataatcgcg cattaagcgg tgtgatgatc aacgctgatg cgggtttagc gattcgcggc
781 attcgccacg tagcggctgg gctggatctt taa
```

Amino acid sequence (SEQ ID NO:182)

```
  1 msdlhnesif itgggsglgl alverfieeg aqvatlelsa akvaslrqrf gehilavegn
 61 vtcyadyqra vdqiltrsgk ldcfignagi wdhnaslvnt paetletgfh elfnvnvlgy
121 llgakacapa liasegsmif tlsnaawypg gggplytask haatgliriql ayelapkvrv
181 ngvgpcgmas dlrgpqalgq setsimqslt pekiaailpl qffpqpadft gpyvmltsrr
241 nnralsgvmi nadaglairg irhvaagldl
```

SrlD (NP_417185)

Nucleotide sequence (SEQ ID NO:183)

```
  1 atgaatcagg ttgccgttgt catcggtggt gggcaaacct taggcgcgtt cctgtgccac
 61 ggtctggctg ccgaggggta tcgcgtcgcg gttgtcgata ttcagagcga caaagccgca
121 aatgtggcac aagaaattaa cgccgaatat ggtgaaagta tggcgtacgg ttttggtgct
181 gacgccacta gcgagcaaag cgttctggcg ctctctcgtg gggtagatga atctttggt
241 cgcgtggatt tgctggtcta cagcgccgga atagcaaaag cagcctttat cagcgacttc
301 cagctcggcg attttgaccg ttcgctacag gtgaatctgg tgggttattt cctgtgtgcg
361 cgtgaatttt cgcgtttgat gatccgcgac gggattcagg ggcgcattat tcagatcaac
421 tcgaaatccg gcaaagtggg cagcaaacac aactctggct acagcgcagc gaaatttggt
481 ggcgtcgggc tgactcaatc actggcgctg gatctggcgg agtacggcat tacggtgcat
541 tcactgatgc tcggtaacct gctgaaatcg ccgatgttcc agtcactgtt gccacaatac
601 gcgaccaagc tgggtatcaa accggatcaa gtcgagcagt attacatcga caaagtaccg
661 ctcaaacgcg gctgcgatta tcaagatgtg ctgaatatgc tgctgttcta cgccagtcct
721 aaggcgtcgt actgcaccgg acagtcgatc aatgtcaccg gcggtcaggt gatgttctga
```

Amino acid sequence (SEQ ID NO:184)

```
  1 mnqvavvigg gqtlgaflch glaaegyrva vvdiqsdkaa nvaqeinaey gesmaygfga
 61 datseqsvla lsrgvdeifg rvdllvysag iakaafisdf qlgdfdrslq vnlvgyflca
121 refsrlmird giqgriiqin sksgkvgskh nsgysaakfg gvgltqslal dlaeygitvh
181 slmlgnllks pmfqsllpqy atklgikpdq veqyyidkvp lkrgcdyqdv lnmllfyasp
241 kasyctgqsi nvtggqvmf
```

KduD (NP_417319)

Nucleotide sequence (SEQ ID NO:185)

```
  1 atgatttttaa gtgcattttc tctcgaaggt aaagttgcgg tcgtcactgg ttgtgatact
 61 ggactgggtc aggggatggc gttggggctg gcgcaagcgg gctgtgacat tgttggcatt
121 aacatcgttg aaccgactga accatcgag caggtcacag cgctgggcg tcgttttta
181 agcctgaccg ccgatctgcg aaagattgat ggtattccag cactgctgga tcgcgcggta
241 gcggagtttg gtcagattga tatcctggtg aataacgccg gattgattcg ccgcgaagat
301 gctctctcgagt tcagcgaaaa ggactgggac gatgtcatga acctgaatat caagagcgta
361 ttcttcatgt ctcaggcagc ggcgaaacac tttatcgcgc aaggcaatgg cggcaagatt
421 atcaatatcg cgtcaatgct ctccttccag ggcgggatcc gtgtgccttc ttataccgca
481 tcaaaaagcg gcgtgatggg tgtgacgcga ttgatggcga cgaatgggc taaacacaac
541 attaatgtta atgcgatagc cccgggttac atggcgacca acaatactca caactacgg
```

FIG. 10Y

```
    601 gcagatgaac aacgtagcgc ggaaattctc gaccgcattc cagctggtcg ttggggactg
    661 ccgagtgacc tgatggggcc gatagtgttc cttgcctcca gcgcttcaga ttatgtgaat
    721 ggttatacca ttgccgtgga tggcggttgg ctggcgcgtt aa
```

Amino acid sequence (SEQ ID NO:186)

```
      1 milsafsleg kvavvtgcdt glgqgmalgl aqagcdivgi niveptetie qvtalgrrfl
     61 sltadlrkid gipallldrav aefghidilv nnaglirred alefsekdwd dvmnlniksv
    121 ffmsqaaakh fiaqgnggki iniasmlsfq ggirvpsyta sksgvmgvtr lmanewakhn
    181 invnaiapgy matnntqqlr adeqrsaeil dripagrwgl psdlmgpivf lassasdyvn
    241 gytiavdggw lar
```

IdnO (NP 418687)

Nucleotide sequence (SEQ ID NO:187)

```
      1 atgaacgatc tattttcact ggcaggaaaa aatatcttga ttaccggttc agcacagggc
     61 attggctttt tactggcaac cggcctgggt aaatatggcg cacaaataat tattaatgat
    121 attactgccg aacgcgcaga acttgctgta gaaaaactcc accaggaggg tattcaggcc
    181 gttgccgcac ttttaatgt tactcataaa catgaaattg atgccgccgt tgaacatatc
    241 gaaaaggaca tcggccccat tgatgtgctg gtgaataacg ccggtatcca gcgccgtcat
    301 cctttttactg agttccctga acaagagtgg aatgatgtga tcgcagtaaa ccagaccgcc
    361 gtgttcctgg tatcgcaagc ggtaactcgt cacatggttg aacgcaaggc aggtaaagtt
    421 attaatattt gctcgatgca aagcgaactg ggacgtgaca ccatcacccc ttatgccgca
    481 tcgaaagggg cggtaaaaat gctcacccgc ggcatgtgcg tcgagctggc gcgccacaat
    541 attcaggtca acggtattgc gccgggctat ttcaaaacag aaatgactaa agcactggtt
    601 gaggacgaag ccttcaccgc ctggttgtgc aaacggaccc ccgccgcacg ctggggagat
    661 ccgcaggaac tgattggtgc tgcggtgttc ctttcttcaa aagcctctga tttcgtaaac
    721 ggccacctgt tgtttgttga tggcggcatg ttagtggctg tttaa
```

Amino acid sequence (SEQ ID NO:188)

```
      1 mndlfslagk nilitgsaqg igfllatglg kygaqiiind itaeraelav eklhqegiqa
     61 vaapfnvthk heidaavehi ekdigpidvl vnnagiqrrh pftefpeqew ndviavnqta
    121 vflvsqavtr hmverkagkv inicsmqsel grdtitpyaa skgavkmltr gmcvelarhn
    181 iqvngiapgy fktemtkalv edeaftawlc krtpaarwgd pqeligaavf lsskasdfvn
    241 ghllfvdggm lvav
```

FabG (NP 415611)

Nucleotide sequence (SEQ ID NO:189)

```
      1 atgaatttg aaggaaaaat cgcactggta accggtgcaa gccgcggaat tggccgcgca
     61 attgctgaaa cgctcgcagc ccgtggcgcg aaagttattg cactgcgac cagtgaaaat
    121 ggcgctcagg cgatcagtga ttatttaggt gccaacggca aggtctgat gttgaatgtg
    181 accgacccgg catctatcga atctgttctg gaaaaaattc gcgcagaatt ggtgaagtg
    241 gatatcctgg tcaataatgc cggtatcact cgtgataacc tgttaatgcg aatgaaagat
    301 gaagagtgga cgatattat cgaaaccaac ctttcatctg ttttccgtct gtcaaaagcg
    361 gtaatgcgcg ctatgatgaa aaagcgtcat ggtcgtatta tcactatcgg ttctgtggtt
    421 ggtaccatgg gaaatggcgg tcaggccaac tacgctgcgg cgaaagcggg cttgatcggc
    481 ttcagtaaat cactggcgcg cgaagttgcg tcacgcggta ttactgtaaa cgttgttgct
    541 ccgggctta ttgaaacgga catgacacgt gcgctgagcg atgaccagcg tgcgggtatc
    601 ctggcgcagg ttcctgcggg tcgcctcggc ggcgcacagg aaatcgccaa cgcggttgca
    661 ttcctggcat ccgacgaagc agcttacatc acgggtgaaa ctttgcatgt gaacggcggg
    721 atgtacatgg tctga
```

Amino acid sequence (SEQ ID NO:190)

```
      1 mnfegkialv tgasrgigra iaetlaarga kvigtatsen gaqaisdylg angkglmlnv
     61 tdpasiesvl ekiraefgev dilvnnagit rdnllmrmkd eewndiietn lssvfrlska
    121 vmrammkkrh griitigsvv gtmgnggqan yaaakaglig fskslareva srgitvnvva
    181 pgfietdmtr alsddqragi laqvpagrlg gaqeianava flasdeaayi tgetlhvngg
    241 mymv
```

FIG. 10Z

FabI (NP 415804)

Nucleotide sequence (SEQ ID NO:191)
```
  1 atgggttttc tttccggtaa gcgcattctg gtaaccggtg ttgccagcaa actatccatc
 61 gcctacggta tcgctcaggc gatgcaccgc gaaggagctg aactggcatt cacctaccag
121 aacgacaaac tgaaaggccg cgtagaagaa tttgccgctc aattgggttc tgacatcgtt
181 ctgcagtgcg atgttgcaga agatgccagc atcgacacca tgttcgctga actggggaaa
241 gtttggccga aatttgacgg tttcgtacac tctattggtt ttgcacctgg cgatcagctg
301 gatggtgact atgttaacgc cgttacccgt gaaggcttca aaattgccca cgacatcagc
361 tcctacagct tcgttgcaat ggcaaaagct tgccgctcca tgctgaatcc gggttctgcc
421 ctgctgaccc tttcctacct tggcgctgag cgcgctatcc gaactacaa cgttatgggt
481 ctggcaaaag cgtctctgga agcgaacgtg cgctatatgg cgaacgcgat gggtccggaa
541 ggtgtgcgtg ttaacgccat ctctgctggt ccgatccgta tctggcggc tccggtatc
601 aaagacttcc gcaaaatgct ggctcattgc gaagccgtta ccccgattcg ccgtaccgtt
661 actattgaag atgtgggtaa ctctgcggca ttcctgtgct ccgatctctc tgccggtatc
721 tccggtgaag tggtccacgt tgacggcggt ttcagcattg ctgcaatgaa cgaactcgaa
781 ctgaaataa
```

Amino acid sequence (SEQ ID NO:192)
```
  1 mgflsgkril vtgvasklsi aygiaqamhr egaelaftyq ndklkgrvee faaqlgsdiv
 61 lqcdvaedas idtmfaelgk vwpkfdgfvh sigfapgdql dgdyvnavtr egfkiahdis
121 sysfvamaka crsmlnpgsa lltlsylgae raipnynvmg lakasleanv rymanamgpe
181 gvrvnaisag pirtlaasgi kdfrkmlahc eavtpirrtv tiedvgnsaa flcsdlsagi
241 sgevvhvdgg fsiaamnele lk
```

YdjA (NP 416279)

Nucleotide sequence (SEQ ID NO:193)
```
  1 atggatgcac tcgaactatt gatcaatcgc cgtagcgcct cccgcttggc tgaacccgcg
 61 ccaacgggtg aacaactgca aaacatcctg cgtgcgggta tgcgtgcgcc ggaccataag
121 tccatgcaac cgtggcattt ttttgtgatt gaaggggaag ggcgcgagcg tttcagcgcc
181 gtactggaac aggggcgat tgctgccggt agtgatgaca agctatcga caaagcccgt
241 aatgcgccgt tccgcgcacc gctcatcatc acggtggtgg cgaaatgcga agagaatcat
301 aaagtcccgc gctgggaaca ggaaatgtct gccggatgcg cggtcatggc gatgcaaatg
361 gcagcagttg cccaggggtt tggcggcatc tggcgcagtg gcgcattaac tgaaagtccg
421 gtagtgcgtg aagcattcgg ttgccgtgag caggataaaa ttgtcggttt tctctacctc
481 ggtacgccgc agctgaaagc atctacgtcg attaacgtcc cggacccgac gccgtttgta
541 acttatttct ga
```

Amino acid sequence (SEQ ID NO:194)
```
  1 mdalellinr rsasrlaepa ptgeqlqnil ragmrapdhk smqpwhffvi egegrerfsa
 61 vleqgaiaag sddkaidkar napfraplii tvvakceenh kvprweqems agcavmamqm
121 aavaqgfggi wrsgaltesp vvreafgcre qdkivgflyl gtpqlkasts invpdptpfv
181 tyf)
```

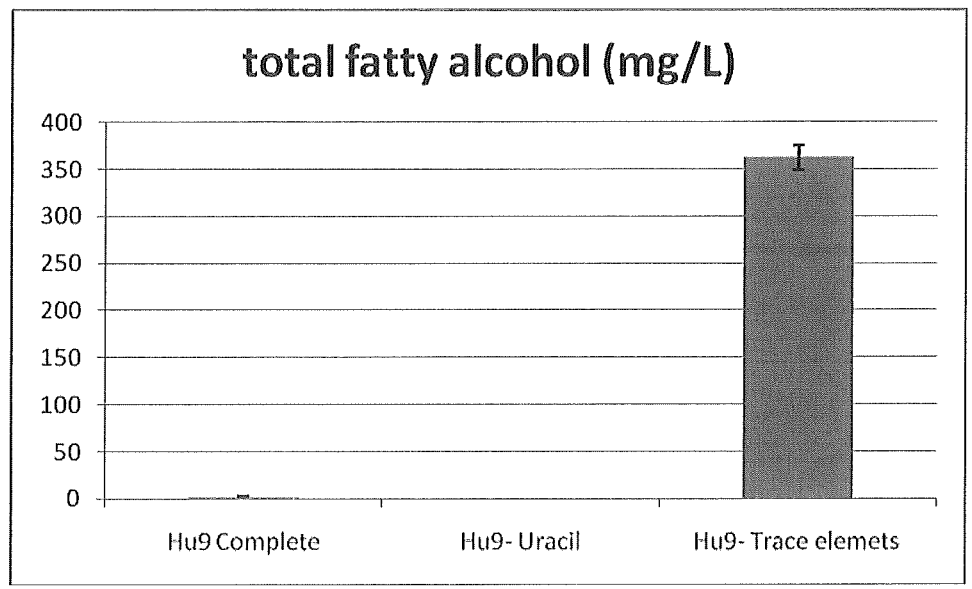
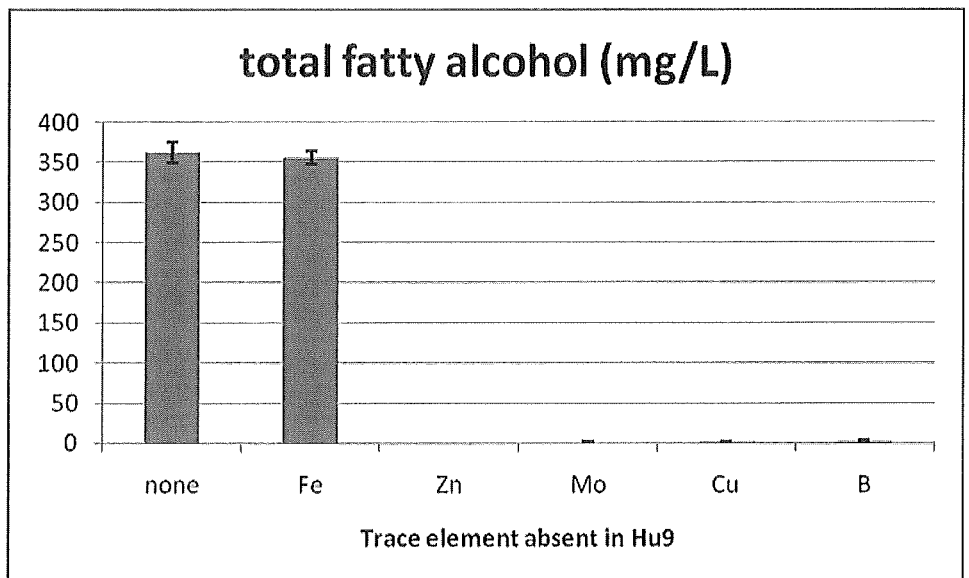
FIG. 14

FIG. 15A

| Gene | Name | Nucleotide Sequence | Protein Sequence |
|---|---|---|---|
| fabA | beta-hydroxydecanoyl thioester dehydrase | atgGTAGATA AACGCGAATC CTATACAAAA GAAGACCTTC TTGCCTCTGG TCGCGGTGAA CTGTTTGGCG CTAAAGGCCC GCAATTGCCA GCACCGAACA TGCTGATGAT GGACCGTGTG GTCAAAATGA CCGAAACGGG TGGTAACTTC GACAAAGGGT ATGTTGAAGC AGAACTGGAT ATCAATCCGG ATCTGTGGTT CTTCGGATGC CACTTTATTG GCGATCCGGT TATGCCGGGA TGCCTGGGCC TGGACGCAAT GTGGCAGCTG GTACGGTTCT ACCTCGGCTG GCTGGGCGGC GAAGGTAAAG GCCGCGCGCT GGGCGTTGGC GAAGTGAAAT TCACTGGTCA GGTACTGCCG ACAGCGAAAA AAGTGACCTA CCGTATTCAC TTTAAACGCA TTGTTAACCG TCGTCTGATT ATGGGCCTGG CGGATGGCGA AGTGCTGGTT GATGGTCGTC TGATCTATAC CGCCAGCGAC CTGAAAGTCG GTCTGTTCCA GGATACGTCT GCCTTCTGA (SEQ ID NO:243) | MVDKRESYTK EDLLASGRGE LFGAKGPQLP APNMLMMDRV VKMTETGGNF DKGYVEAELD INPDLWFFGC HFIGDPVMPG CLGLDAMWQL VGFYLGWLGG EGKGRALGVG EVKFTGQVLP TAKKVTYRIH FKRIVNRRLI MGLADGEVLV DGRLIYTASD LKVGLFQDTS AF (SEQ ID NO:244) |

FIG. 15B

| fabZ | (3R)-hydroxymyristol acyl carrier protein dehydratase | ttgACTACTA ACACTCATAC TCTGCAGATT GAAGAGATTT TAGAACTTCT GCCGCACCGT TTCCCGTTCT TACTGGTGGA TCGCGTGCTG GATTTTGAAG AAGGTCGTTT TCTGCGCGCA GTAAAAAATG TCTCTGTCAA TGAGCCATTC TTCCAGGGCC ATTTCCCTGG AAAACCGATT TTCCCGGGTG TGCTGATTCT GGAAGCAATG GCACAGGCAA CAGGTATTCT GGCGTTTAAA AGCGTAGGAA AACTGGAACC GGGTGAGCTG TACTACTTCG CTGGTATTGA CGAAGCGCGC TTCAAGCGCC CGGTCGTGCC TGGCGATCAA ATGATCATGG AAGTCACTTT CGAAAAAACG CGCCGCGGCC TGACCCGTTT TAAAGGGGTT GCTCTGGTCG ATGGTAAAGT AGTTTGCGAA GCAACGATGA TGTGTGCTCG TAGCCGGGAG GCCTGA (SEQ ID NO:245) | MTTNTHTLQI EEILELLPHR FPFLLVDRVL DFEEGRFLRA VKNVSVNEPF FQGHFPGKPI FPGVLILEAM AQATGILAFK SVGKLEPGEL YYFAGIDEAR FKRPVVPGDQ MIMEVTFEKT RRGLTRFKGV ALVDGKVVCE ATMMCARSRE A (SEQ ID NO:246) |

FIG. 15C

| cysM | cysteine synthase B (O-acetylserine sulfhydrolase B) | gtgAGTACAT TAGAACAAAC AATAGGCAAT ACGCCTCTGG TGAAGTTGCA GCGAATGGGG CCGGATAACG GCAGTGAAGT GTGGTTAAAA CTGGAAGGCA ATAACCCGGC AGGTTCGGTG AAAGATCGTG CGGCACTTTC GATGATCGTC GAGGCGGAAA AGCGCGGGA AATTAAACCG GGTGATGTCT TAATCGAAGC CACCAGTGGT AACACCGGCA TTGCGCTGGC AATGATTGCC GCGCTGAAAG GCTATCGCAT GAAATTGCTG ATGCCCGACA ACATGAGCCA GGAACGCCGT GCGGCGATGC GTGCTTATGG TGCGGAACTG ATTCTTGTCA CCAAAGAGCA GGGCATGGAA GGTGCGCGCG ATCTGGCGCT GGAGATGGCG AATCGTGGCG AAGGAAAGCT GCTCGATCAG TTCAATAATC CCGATAACCC TTATGCGCAT TACACCACCA CTGGGCCGGA AATCTGGCAG CAAACCGGCG GGCGCATCAC TCATTTTGTC TCCAGCATGG GGACGACCGG CACTATCACC GGCGTCTCAC GCTTTATGCG CGAACAATCC AAACCGGTGA CCATTGTCGG CCTGCAACCG GAAGAGGGCA GCAGCATTCC CGGCATTCGC CGCTGGCCTA CGGAATATCT GCCGGGGATT TTCAACGCTT CTCTGGTGGA TGAGGTGCTG GATATTCATC AGCGCGATGC GGAAAACACC ATGCGCGAAC TGGCGGTGCG GGAAGGAATA TTCTGTGGCG TCAGCTCCGG CGGCGCGGTT GCCGGAGCAC TGCGGGTGGC AAAAGCTAAC CCTGACGCGG TGGTGGTGGC GATCATCTGC GATCGTGGCG ATCGCTACCT TTCTACCGGG GTGTTTGGGG AAGAGCATTT TAGCCAGGGG GCGGGGATTT AA (SEQ ID NO:247) | MSTLEQTIGN TPLVKLQRMG PDNGSEVWLK LEGNNPAGSV KDRAALSMIV EAEKRGEIKP GDVLIEATSG NTGIALAMIA ALKGYRMKLL MPDNMSQERR AAMRAYGAEL ILVTKEQGME GARDLALEMA NRGEGKLLDQ FNNPDNPYAH YTTTGPEIWQ QTGGRITHFV SSMGTTGTIT GVSRFMREQS KPVTIVGLQP EEGSSIPGIR RWPTEYLPGI FNASLVDEVL DIHQRDAENT MRELAVREGI FCGVSSGGAV AGALRVAKAN PDAVVVAIIC DRGDRYLSTG VFGEEHFSQG AGI (SEQ ID NO:248) |

FIG. 15D

| maoC | fused aldehyde dehydrogenase/enoyl-CoA hydratase | atgCAGCAGT TAGCCAGTTT<br>CTTATCCGGT ACCTGGCAGT<br>CTGGCCGGGG CCCTAGCCGT<br>TTGATTCACC ACGCTATTAG<br>CGGCGAGGCG TTATGGGAAG<br>TGACCAGTGA AGGTCTTGAT<br>ATGGCGGCTG CCCGCCAGTT<br>TGCCATTGAA AAAGGTGCCC<br>CCGCCCTTCG CGCTATGACC<br>TTTATCGAAC GTGCGGCGAT<br>GCTTAAAGCG GTCGCTAAAC<br>ATCTGCTGAG TGAAAAAGAG<br>CGTTTCTATG CTCTTTCTGC<br>GCAAACAGGC GCAACGCGGG<br>CAGACAGTTG GGTTGATATT<br>GAAGGTGGCA TTGGGACGTT<br>ATTTACTTAC GCCAGCCTCG<br>GTAGCCGGGA GCTGCCTGAC<br>GATACGCTGT GGCCGGAAGA<br>TGAATTGATC CCCTTATCGA<br>AAGAAGGTGG ATTTGCCGCG<br>CGCCATTTAC TGACCTCAAA<br>GTCAGGCGTG GCAGTGCATA<br>TTAACGCCTT TAACTTCCCC<br>TGCTGGGGAA TGCTGGAAAA<br>GCTGGCACCA ACGTGGCTGG<br>GCGGAATGCC AGCCATCATC<br>AAACCAGCTA CCGCGACGGC<br>CCAACTGACT CAGGCGATGG<br>TGAAATCAAT TGTCGATAGT<br>GGTCTTGTTC CCGAAGGCGC<br>AATTAGTCTG ATCTGCGGTA<br>GTGCTGGCGA CTTGTTGGAT<br>CATCTGGACA GCCAGGATGT<br>GGTGACTTTC ACGGGGTCAG<br>CGGCGACCGG ACAGATGCTG<br>CGAGTTCAGC CAAATATCGT<br>CGCCAAATCT ATCCCCTTCA<br>CTATGGAAGC TGATTCCCTG<br>AACTGCTGCG TACTGGGCGA<br>AGATGTCACC CCGGATCAAC<br>CGGAGTTTGC GCTGTTTATT<br>CGTGAAGTTG TGCGTGAGAT<br>GACCACAAAA GCCGGGCAAA<br>AATGTACGGC AATCCGGCGG<br>ATTATTGTGC CGCAGGCATT<br>GGTTAATGCT GTCAGTGATG<br>CTCTGGTTGC GCGATTACAG<br>AAAGTCGTGG TCGGTGATCC<br>TGCTCAGGAA GGCGTGAAAA<br>TGGGCGCACT GGTAAATGCT<br>GAGCAGCGTG CCGATGTGCA<br>GGAAAAGTG AACATATTGC<br>TGGCTGCAGG ATGCGAGATT | MQQLASFLSG<br>TWQSGRGRSR<br>LIHHAISGEA<br>LWEVTSEGLD<br>MAAARQFAIE<br>KGAPALRAMT<br>FIERAAMLKA<br>VAKHLLSEKE<br>RFYALSAQTG<br>ATRADSWVDI<br>EGGIGTLFTY<br>ASLGSRELPD<br>DTLWPEDELL<br>PLSKEGGFAA<br>RHLLTSKSGV<br>AVHINAFNFP<br>CWGMLEKLAP<br>TWLGGMPAII<br>KPATATAQLT<br>QAMVKSIVDS<br>GLVPEGAISL<br>ICGSAGDLLD<br>HLDSQDVVTF<br>TGSAATGQML<br>RVQPNIVAKS<br>IPFTMEADSL<br>NCCVLGEDVT<br>PDQPEFALFI<br>REVVREMTTK<br>AGQKCTAIRR<br>IIVPQALVNA<br>VSDALVARLQ<br>KVVVGDPAQE<br>GVKMGALVNA<br>EQRADVQEKV<br>NILLAAGCEI<br>RLGGQADLSA<br>AGAFFPPTLL<br>YCPQPDETPA<br>VHATEAFGPV<br>ATLMPAQNQR<br>HALQLACAGG<br>GSLAGTLVTA<br>DPQIARQFIA<br>DAARTHGRIQ<br>ILNEESAKES<br>TGHGSPLPQL<br>VHGGPGRAGG<br>GEELGGLRAV<br>KHYMQRTAVQ<br>GSPTMLAAIS<br>KQWVRGAKVE<br>EDRIHPFRKY<br>FEELQPGDSL |

FIG. 15E

| | | CGCCTCGGTG GTCAGGCGGA<br>TTTATCTGCT GCGGGTGCCT<br>TCTTCCCGCC AACCTTATTG<br>TACTGTCCGC AGCCGGATGA<br>AACACCGGCG GTACATGCAA<br>CAGAAGCCTT TGGCCCTGTC<br>GCAACGCTGA TGCCAGCACA<br>AAACCAGCGA CATGCTCTGC<br>AACTGGCTTG TGCAGGCGGC<br>GGTAGCCTTG CGGGAACGCT<br>GGTGACGGCT GATCCGCAAA<br>TTGCGCGTCA GTTTATTGCC<br>GACGCGGCAC GTACGCATGG<br>GCGAATTCAG ATCCTCAATG<br>AAGAGTCGGC AAAAGAATCC<br>ACCGGGCATG GCTCCCCACT<br>GCCACAACTG GTACATGGTG<br>GGCCTGGTCG CGCAGGAGGC<br>GGTGAAGAAT TAGGCGGTTT<br>ACGAGCGGTG AAACATTACA<br>TGCAGCGAAC CGCTGTTCAG<br>GGTAGTCCGA CGATGCTTGC<br>CGCTATCAGT AAACAGTGGG<br>TGCGCGGTGC GAAAGTCGAA<br>GAAGATCGTA TTCATCCGTT<br>CCGCAAATAT TTTGAGGAGC<br>TACAACCAGG CGACAGCCTG<br>TTGACTCCCC GCCGCACAAT<br>GACAGAGGCC GATATTGTTA<br>ACTTTGCTTG CCTCAGCGGC<br>GATCATTTCT ATGCACATAT<br>GGATAAGATT GCTGCTGCCG<br>AATCTATTTT CGGTGAGCGG<br>GTGGTGCATG GGTATTTTGT<br>GCTTTCTGCG GCTGCGGGTC<br>TGTTTGTCGA TGCCGGTGTC<br>GGTCCGGTCA TTGCTAACTA<br>CGGGCTGGAA AGCTTGCGTT<br>TTATCGAACC CGTAAAGCCA<br>GGCGATACCA TCCAGGTGCG<br>TCTCACCTGT AAGCGCAAGA<br>CGCTGAAAAA ACAGCGTAGC<br>GCAGAAGAAA AACCAACAGG<br>TGTGGTGGAA TGGGCTGTAG<br>AGGTATTCAA TCAGCATCAA<br>ACCCCGGTGG CGCTGTATTC<br>AATTCTGACG CTGGTGGCCA<br>GGCAGCACGG TGATTTTGTC<br>GATTAA (SEQ ID NO:249) | LTPRRTMTEA<br>DIVNFACLSG<br>DHFYAHMDKI<br>AAAESIFGER<br>VVHGYFVLSA<br>AAGLFVDAGV<br>GPVIANYGLE<br>SLRFIEPVKP<br>GDTIQVRLTC<br>KRKTLKKQRS<br>AEEKPTGVVE<br>WAVEVFNQHQ<br>TPVALYSILT<br>LVARQHGDFV D (SEQ ID NO:250) |

FIG. 15F

| Source | Genbank Accession Number |
|---|---|
| Shigella sp. D9 | ZP_05432652 |
| Citrobacter youngae ATCC 29220 | ZP_04561391.1 |
| Salmonella enterica | YP_001570967.1 |
| Escherichia fergusonii ATCC 35469 | YP_002382254.1 |
| Klebsiella pneumoniae NTUH-K2044 | YP_002918743.1 |
| Enterobacter cancerogenus ATCC 35316 | ZP_03281954.1 |
| Cronobacter turicensis | CBA29728.1 |
| Erwinia pyrifoliae Ep1/96 | YP_002649242.1 |
| Pectobacterium carotovorum subsp. carotovorum PC1 | YP_003018119.1 |
| Dickeya dadantii Ech703 | YP_002987184.1 |
| Edwardsiella ictaluri 93-146 | YP_002932813.1 |
| Providencia alcalifaciens DSM 30120 | ZP_03317956.1 |
| Yersinia kristensenii ATCC 33638 | ZP_04624337.1 |
| Photorhabdus asymbiotica | YP_003041580.1 |
| Pantoea sp. At-9b | ZP_05728924.1 |
| Actinobacillus succinogenes 130Z | YP_001344737.1 |

FIG. 15G

| | |
|---|---|
| Mannheimia succiniciproducens MBEL55E | YP_088386.1 |
| Pasteurella multocida subsp. multocida str. Pm70 | NP_245421.1 |
| Haemophilus somnus 129PT | YP_719117.1 |
| Proteus mirabilis HI4320 | YP_002150544.1 |
| Sodalis glossinidius str. 'morsitans' | YP_454706.1 |
| Candidatus Blochmannia pennsylvanicus str. BPEN | YP_277927.1 |
| Aggregatibacter aphrophilus NJ8700 | YP_003007342.1 |
| Vibrio cholerae MZO-3 | ZP_01958381.1 |
| Baumannia cicadellinicola str. Hc (Homalodisca coagulata) | YP_588853.1 |
| Vibrionales bacterium SWAT-3 | ZP_01815187.1 |
| Aliivibrio salmonicida LFI1238 | YP_002262988.1 |
| Aeromonas salmonicida subsp. salmonicida A449 | YP_001141819.1 |
| Wigglesworthia glossinidia endosymbiont of Glossina brevipalpis | NP_871303.1 |
| Glaciecola sp. HTCC2999 | ZP_03560821.1 |
| Alteromonas macleodii ATCC 27126 | ZP_04714556.1 |

FIG. 16A

| Gene | Name | Nucleotide Sequence | Protein Sequence |
|---|---|---|---|
| fabB | B-ketoacyl synthase/ 3-oxoacyl-[acyl-carrier-protein] synthase I | atgAAACGTG CAGTGATTAC TGGCCTGGGC ATTGTTTCCA GCATCGGTAA TAACCAGCAG GAAGTCCTGG CATCTCTGCG TGAAGGACGT TCAGGGATCA CTTTCTCTCA GGAGCTGAAG GATTCCGGCA TGCGTAGCCA CGTCTGGGGC AACGTAAAAC TGGATACCAC TGGCCTCATT GACCGCAAAG TTGTGCGCTT TATGAGCGAC GCATCCATTT ATGCATTCCT TTCTATGGAG CAGGCAATCG CTGATGCGGG CCTCTCTCCG GAAGCTTACC AGAATAACCC GCGCGTTGGC CTGATTGCAG GTTCCGGCGG CGGCTCCCCG CGTTTCCAGG TGTTCGGCGC TGACGCAATG CGCGGCCCGC GCGGCCTGAA AGCGGTTGGC CCGTATGTGG TCACCAAAGC GATGGCATCC GGCGTTTCTG CCTGCCTCGC CACCCCGTTT AAAATTCATG GCGTTAACTA CTCCATCAGC TCCGCGTGTG CGACTTCCGC ACACTGTATC GGTAACGCAG TAGAGCAGAT CCAACTGGGC AAACAGGACA TCGTGTTTGC TGGCGGCGGC GAAGAGCTGT GCTGGGAAAT GGCTTGCGAA TTCGACGCAA TGGGTGCGCT GTCTACTAAA TACAACGACA CCCCGGAAAA AGCCTCCCGT ACTTACGACG CTCACCGTGA CGGTTTCGTT ATCGCTGGCG GCGGCGGTAT GGTAGTGGTT GAAGAGCTGG AACACGCGCT GGCGCGTGGT GCTCACATCT ATGCTGAAAT CGTTGGCTAC GGCGCAACCT CTGATGGTGC AGACATGGTT GCTCCGTCTG GCGAAGGCGC AGTACGCTGC ATGAAGATGG CGATGCATGG CGTTGATACC CCAATCGATT ACCTGAACTC CCACGGTACT TCGACTCCGG TTGGCGACGT GAAAGAGCTG GCAGCTATCC GTGAAGTGTT CGGCGATAAG AGCCCGGCGA TTTCTGCAAC CAAAGCCATG ACCGGTCACT CTCTGGGCGC TGCTGGCGTA CAGGAAGCTA TCTACTCTCT | MKRAVITGLG IVSSIGNNQQ EVLASLREGR SGITFSQELK DSGMRSHVWG NVKLDTTGLI DRKVVRFMSD ASIYAFLSME QAIADAGLSP EAYQNNPRVG LIAGSGGGSP RFQVFGADAM RGPRGLKAVG PYVVTKAMAS GVSACLATPF KIHGVNYSIS SACATSAHCI GNAVEQIQLG KQDIVFAGGG EELCWEMACE FDAMGALSTK YNDTPEKASR TYDAHRDGFV IAGGGMVVV EELEHALARG AHIYAEIVGY GATSDGADMV APSGEGAVRC MKMAMHGVDT PIDYLNSHGT STPVGDVKEL AAIREVFGDK SPAISATKAM TGHSLGAAGV QEAIYSLLML EHGFIAPSIN IEELDEQAAG LNIVTETTDR ELTTVMSNSF GFGGTNATLV MRKLKD (SEQ ID NO:252) |

FIG. 16B

| | | | |
|---|---|---|---|
| | | GCTGATGCTG GAACACGGCT TTATCGCCCC GAGCATCAAC ATTGAAGAGC TGGACGAGCA GGCTGCGGGT CTGAACATCG TGACCGAAAC GACCGATCGC GAACTGACCA CCGTTATGTC TAACAGCTTC GGCTTCGGCG GCACCAACGC CACGCTGGTA ATGCGCAAGC TGAAAGATTA A (SEQ ID NO:251) | |
| fabF | 3-oxoacyl-[acyl-carrier-protein] synthase II | gtgTCTAAGC GTCGTGTAGT TGTGACCGGA CTGGGCATGT TGTCTCCTGT CGGCAATACC GTAGAGTCTA CCTGGAAAGC TCTGCTTGCC GGTCAGAGTG GCATCAGCCT AATCGACCAT TTCGATACTA GCGCCTATGC AACGAAATTT GCTGGCTTAG TAAAGGATTT TAACTGTGAG GACATTATCT CGCGCAAAGA ACAGCGCAAG ATGGATGCCT TCATTCAATA TGGAATTGTC GCTGGCGTTC AGGCCATGCA GGATTCTGGC CTTGAAATAA CGGAAGAGAA CGCAACCCGC ATTGGTGCCG CAATTGGCTC CGGGATTGGC GGCCTCGGAC TGATCGAAGA AAACCACACA TCTCTGATGA ACGGTGGTCC ACGTAAGATC AGCCCATTCT TCGTTCCGTC AACGATTGTG AACATGGTGG CAGGTCATCT GACTATCATG TATGGCCTGC GTGGCCCGAG CATCTCTATC GCGACTGCCT GTACTTCCGG CGTGCACAAC ATTGGCCATG CTGCGCGTAT TATCGCGTAT GGCGATGCTG ACGTGATGGT TGCAGGTGGC GCAGAGAAAG CCAGTACGCC GCTGGGCGTT GGTGGTTTTG GCGCGGCACG TGCATTATCT ACCCGCAATG ATAACCCGCA AGCGGCGAGC CGCCCGTGGG ATAAAGAGCG TGATGGTTTC GTACTGGGCG ATGGTGCCGG TATGCTGGTA CTTGAAGAGT ACGAACAGGC GAAAAACGC GGTGCGAAAA TTTACGCTGA ACTCGTCGGC TTTGGTATGA GCAGCGATGC TTATCATATG ACGTCACCGC CAGAAAATGG CGCAGGCGCA | MSKRRVVVTG LGMLSPVGNT VESTWKALLA GQSGISLIDH FDTSAYATKF AGLVKDFNCE DIISRKEQRK MDAFIQYGIV AGVQAMQDSG LEITEENATR IGAAIGSGIG GLGLIEENHT SLMNGGPRKI SPFFVPSTIV NMVAGHLTIM YGLRGPSISI ATACTSGVHN IGHAARIIAY GDADVMVAGG AEKASTPLGV GGFGAARALS TRNDNPQAAS RPWDKERDGF VLGDGAGMLV LEEYEHAKKR GAKIYAELVG FGMSSDAYHM TSPPENGAGA ALAMANALRD AGIEASQIGY VNAHGTSTPA GDKAEAQAVK TIFGEAASRV LVSSTKSMTG HLLGAAGAVE SIYSILALRD QAVPPTINLD NPDEGCDLDF VPHEARQVSG MEYTLCNSFG FGGTNGSLIF KKI (SEQ ID NO:254) | |

FIG. 16C

| | | | |
|---|---|---|---|
| | | GCTCTGGCGA TGGCAAATGC TCTGCGTGAT GCAGGCATTG AAGCGAGTCA GATTGGCTAC GTTAACGCGC ACGGTACTTC TACGCCGGCT GGCGATAAAG CTGAAGCGCA GGCGGTGAAA ACCATCTTCG GTGAAGCTGC AAGCCGTGTG TTGGTAAGCT CCACGAAATC TATGACCGGT CACCTGTTAG GTGCGGCGGG TGCAGTAGAA TCTATCTACT CCATCCTGGC GCTGCGCGAT CAGGCTGTTC CGCCAACCAT CAACCTGGAT AACCCGGATG AAGGTTGCGA TCTGGATTTC GTACCGCACG AAGCCCGTCA GGTTAGCGGA ATGGAATACA CTCTGTGTAA CTCCTTCGGC TTCGGTGGCA CTAATGGTTC TTTGATCTTT AAAAAGATCT AA (SEQ ID NO:253) | |
| fadJ | fused enoyl-CoA hydratase and epimerase and isomerase/3-hydroxyacyl-CoA dehydrogenase | atgGAAATGA CATCAGCGTT TACCCTTAAT GTTCGTCTGG ACAACATTGC CGTTATCACC ATCGACGTAC CGGGTGAGAA AATGAATACC CTGAAGGCGG AGTTTGCCTC GCAGGTGCGC GCCATTATTA AGCAACTCCG TGAAAACAAA GAGTTGCGAG GCGTGGTGTT TGTCTCCGCT AAACCGGACA ACTTCATTGC TGGCGCAGAC ATCAACATGA TCGGCAACTG CAAAACGGCG CAAGAAGCGG AAGCTCTGGC GCGGCAGGGC CAACAGTTGA TGGCGGAGAT TCATGCTTTG CCCATTCAGG TTATCGCGGC TATTCATGGC GCTTGCCTGG GTGGTGGGCT GGAGTTGGCG CTGGCGTGCC ACGGTCGCGT TTGTACTGAC GATCCTAAAA CGGTGCTCGG TTTGCCTGAA GTACAACTTG GATTGTTACC CGGTTCAGGC GGCACCCAGC GTTTACCGCG TCTGATAGGC GTCAGCACAG CATTAGAGAT GATCCTCACC GGAAAACAAC TTCGGGCGAA ACAGGCATTA AAGCTGGGGC TGGTGGATGA CGTTGTTCCG CACTCCATTC TGCTGGAAGC CGCTGTTGAG CTGGCAAAGA AGGAGCGCCC ATCTTCCCGC CCTCTACCTG | MEMTSAFTLN VRLDNIAVIT IDVPGEKMNT LKAEFASQVR AIIKQLRENK ELRGVVFVSA KPDNFIAGAD INMIGNCKTA QEAEALARQG QQLMAEIHAL PIQVIAAIHG ACLGGGLELA LACHGRVCTD DPKTVLGLPE VQLGLLPGSG GTQRLPRLIG VSTALEMILT GKQLRAKQAL KLGLVDDVVP HSILLEAAVE LAKKERPSSR PLPVRERILA GPLGRALLFK MVGKKTEHKT QGNYPATERI LEVVETGLAQ GTSSGYDAEA RAFGELAMTP QSQALRSIFF ASTDVKKDPG SDAPPAPLNS VGILGGGLMG |

FIG. 16D

| | | | |
|---|---|---|---|
| | | TACGCGAGCG TATTCTGGCG<br>GGGCCGTTAG GTCGTGCGCT<br>GCTGTTCAAA ATGGTCGGCA<br>AGAAAACAGA ACACAAAACT<br>CAAGGCAATT ATCCGGCGAC<br>AGAACGCATC CTGGAGGTTG<br>TTGAAACGGG ATTAGCGCAG<br>GGCACCAGCA GCGGTTATGA<br>CGCCGAAGCT CGGGCGTTTG<br>GCGAACTGGC GATGACGCCA<br>CAATCGCAGG CGCTGCGTAG<br>TATCTTTTTT GCCAGTACGG<br>ACGTGAAGAA AGATCCGGC<br>AGTGATGCGC CGCCTGCGCC<br>ATTAAACAGC GTGGGGATTT<br>TAGGTGGTGG CTTGATGGGC<br>GGCGGTATTG CTTATGTCAC<br>TGCTTGTAAA GCGGGGATTC<br>CGGTCAGAAT TAAAGATATC<br>AACCCGCAGG GCATAAATCA<br>TGCGCTGAAG TACAGTTGGG<br>ATCAGCTGGA GGGCAAAGTT<br>CGCCGTCGTC ATCTCAAAGC<br>CAGCGAACGT GACAAACAGC<br>TGGCATTAAT CTCCGGAACG<br>ACGGACTATC GCGGCTTTGC<br>CCATCGCGAT CTGATTATTG<br>AAGCGGTGTT TGAAAATCTC<br>GAATTGAAAC AACAGATGGT<br>GGCGGAAGTT GAGCAAAATT<br>GCGCCGCTCA TACCATCTTT<br>GCTTCGAATA CGTCATCTTT<br>ACCGATTGGT GATATCGCCG<br>CTCACGCCAC GCGACCTGAG<br>CAAGTTATCG GCCTGCATTT<br>CTTCAGTCCG GTGGAAAAAA<br>TGCCGCTGGT GGAGATTATT<br>CCTCATGCGG GGACATCGGC<br>GCAAACCATC GCTACCACAG<br>TAAAACTGGC GAAAAACAG<br>GGTAAAACGC CAATTGTCGT<br>GCGTGACAAA GCCGGTTTTT<br>ACGTCAATCG CATCTTAGCG<br>CCTTACATTA ATGAAGCTAT<br>CCGCATGTTG ACCCAAGGTG<br>AACGGGTAGA GCACATTGAT<br>GCCGCGCTAG TGAAATTTGG<br>TTTTCCGGTA GGCCCAATCC<br>AACTTTTGGA TGAGGTAGGA<br>ATCGACACCG GGACTAAAAT<br>TATTCCTCTA CTGGAAGCCG<br>CTTATGGAGA ACGTTTTAGC<br>GCGCCTGCAA ATGTTGTTTC | GGIAYVTACK<br>AGIPVRIKDI<br>NPQGINHALK<br>YSWDQLEGKV<br>RRRHLKASER<br>DKQLALISGT<br>TDYRGFAHRD<br>LIIEAVFENL<br>ELKQQMVAEV<br>EQNCAAHTIF<br>ASNTSSLPIG<br>DIAAHATRPE<br>QVIGLHFFSP<br>VEKMPLVEII<br>PHAGTSAQTI<br>ATTVKLAKKQ<br>GKTPIVVRDK<br>AGFYVNRILA<br>PYINEAIRML<br>TQGERVEHID<br>AALVKFGFPV<br>GPIQLLDEVG<br>IDTGTKIIPV<br>LEAAYGERFS<br>APANVVSSIL<br>NDDRKGRKNG<br>RGFYLYGQKG<br>RKSKKQVDPA<br>IYPLIGTQGQ<br>GRISAPQVAE<br>RCVMLMLNEA<br>VRCVDEQVIR<br>SVRDGDIGAV<br>FGIGFPPFLG<br>GPFRYIDSLG<br>AGEVVAIMQR<br>LATQYGSRFT<br>PCERLVEMGA<br>RGESFWKTTA TDLQ<br>(SEQ ID NO:256) |

FIG. 16E

| | | | |
|---|---|---|---|
| | | TTCAATTTTG AACGACGATC GCAAAGGCAG AAAAAATGGC CGGGGTTTCT ATCTTTATGG TCAGAAAGGG CGTAAAAGCA AAAAACAGGT CGATCCCGCC ATTTACCCGC TGATTGGCAC ACAAGGGCAG GGGCGAATCT CCGCACCGCA GGTTGCTGAA CGGTGTGTGA TGTTGATGCT GAATGAAGCA GTACGTTGTG TTGATGAGCA GGTTATCCGT AGCGTGCGTG ACGGGGATAT TGGCGCGGTA TTTGGCATTG GTTTTCCGCC ATTTCTCGGT GGACCGTTCC GCTATATCGA TTCTCTCGGC GCGGGCGAAG TGGTTGCAAT AATGCAACGA CTTGCCACGC AGTATGGTTC CCGTTTTACC CCTTGCGAGC GTTTGGTCGA GATGGGCGCG CGTGGGGAAA GTTTTTGGAA AACAACTGCA ACTGACCTGC AATAA (SEQ ID NO:255) | |
| xerC | site-specific tyrosine recombinase | atgACCGATT TACACACCGA TGTAGAACGC TACCTACGTT ATCTGAGCGT GGAGCGCCAG CTTAGCCCGA TAACCCTGCT TAACTACCAG CGTCAGCTTG AGGCGATCAT CAATTTTGCC AGCGAAAACG GCCTGCAAAG CTGGCAGCAA TGTGATGTGA CGATGGTGCG CAATTTTGCT GTACGCAGTC GCCGTAAAGG GCTGGGAGCA GCAAGTCTGG CGTTACGGCT TTCTGCGCTA CGTAGCTTTT TTGACTGGCT GGTCAGCCAG AACGAACTCA AAGCTAACCC GGCGAAAGGT GTTTCGGCAC CGAAAGCGCC GCGTCATCTG CCGAAAAACA TCGACGTCGA CGATATGAAT CGGCTGCTGG ATATTGATAT CAATGATCCC CTCGCTGTAC GCGACCGTGC AATGCTGGAA GTGATGTACG GCGCGGGTCT GCGTCTTTCT GAGCTGGTGG GGCTGGATAT TAAACACCTC GACCTGGAGT CTGGTGAAGT GTGGGTTATG GGGAAAGGCA GCAAAGAGCG CCGCCTGCCG ATTGGTCGCA ACGCTGTGGC GTGGATTGAG CACTGGCTTG ATTTGCGCGA CCTGTTTGGT | MTDLHTDVER YLRYLSVERQ LSPITLNYQ RQLEAIINFA SENGLQSWQQ CDVTMVRNFA VRSRRKGLGA ASLALRLSAL RSFFDWLVSQ NELKANPAKG VSAPKAPRHL PKNIDVDDMN RLLDIDINDP LAVRDRAMLE VMYGAGLRLS ELVGLDIKHL DLESGEVWVM GKGSKERRLP IGRNAVAWIE HWLDLRDLFG SEDDALFLSK LGKRISARNV QKRFAEWGIK QGLNNHVHPH KLRHSFATHM LESSGDLRGV QELLGHANLS TTQIYTHLDF QHLASVYDAA HPRAKRGK (SEQ ID NO:258) |

FIG. 16F

| | | AGCGAAGACG ACGCGCTTTT TCTGTCGAAA CTGGGCAAGC GTATCTCCGC GCGTAATGTG CAGAAACGCT TTGCCGAATG GGGCATAAAA CAAGGGCTGA ATAATCACGT TCATCCGCAT AAATTACGTC ACTCGTTCGC CACGCATATG CTGGAGTCGA GCGGCGATCT TCGTGGTGTG CAGGAGCTGC TGGGTCATGC CAACCTCTCC ACCACGCAAA TCTATACTCA TCTTGATTTT CAACACCTTG CCTCGGTGTA CGATGCGGCG CATCCACGCG CCAAACGGGG GAAATAA (SEQ ID NO:257) | |
|---|---|---|---|
| yqeF | predicted acyltransferase | atgAAAGACG TTGTGATTGT CGGGGCGTTA CGGACACCTA TCGGCTGCTT TCGTGGTGCG TTAGCGGGTC ATTCCGCCGT GGAACTTGGT AGTCTGGTCG TGAAAGCGTT AATAGAACGT ACCGGCGTTC CTGCATATGC GGTGGATGAA GTAATTCTTG GTCAGGTGTT GACTGCAGGG GCAGGGCAGA ATCCGGCAAG GCAATCGGCT ATTAAAGGTG GTCTGCCTAA TAGCGTTTCT GCAATCACTA TTAATGACGT TTGCGGTTCC GGGCTTAAAG CACTGCATCT GGCTACTCAG GCGATACAGT GTGGCGAGGC TGATATTGTC ATCGCCGGTG GCCAGGAAAA CATGAGCCGC GCACCACATG TTCTGACTGA TAGCCGCACC GGTGCACAGC TTGGCAATAG CCAGTTGGTT GACAGTCTTG TGCATGATGG GTTGTGGGAT GCCTTCAATG ATTATCATAT TGGTGTCACC GCCGAAAATC TGGCTCGCGA ATATGGCATC AGCCGTCAGT TGCAGGATGC TTACGCACTT AGCTCGCAAC AAAAAGCGCG AGCGGCGATT GACGCCGGAC GATTTAAAGA TGAGATCGTC CCCGGTAATGA CCCAAAGTAA CGGGCAGACG TTGGTTGTTG ATACCGATGA ACAGCCACGC ACTGACGCCA GCGCAGAAGG CTTAGCCCGT TTAAATCCTT CATTTGATAG TCTCGGTTCT GTGACAGCGG GTAATGCATC | MKDVVIVGAL RTPIGCFRGA LAGHSAVELG SLVVKALIER TGVPAYAVDE VILGQVLTAG AGQNPARQSA IKGGLPNSVS AITINDVCGS GLKALHLATQ AIQCGEADIV IAGGQENMSR APHVLTDSRT GAQLGNSQLV DSLVHDGLWD AFNDYHIGVT AENLAREYGI SRQLQDAYAL SSQQKARAAI DAGRFKDEIV PVMTQSNGQT LVVDTDEQPR TDASAEGLAR LNPSFDSLGS VTAGNASSIN DGAAAVMMMS EAKARALNLP VLARIRAFAS VGVDPALMGI APVYATRRCL ERVGWQLAEV DLIEANEAFA AQALSVGKML EWDERRVNVN GGAIALGHPI GASGCRILVS LVHEMVKRNA |

FIG. 16G

| | | | |
|---|---|---|---|
| | | ATCCATAAAC GATGGCGCAG CTGCGGTAAT GATGATGAGC GAAGCCAAAG CACGAGCGTT GAATTTACCC GTGCTGGCCC GCATTCCGCG ATTTGCCAGC GTTGGTGTAG ATCCGGCATT GATGGGAATT GCGCCGGTGT ATGCGACCCG CCGTTGCCTG GAGCGTGTAG GCTGGCAGTT GGCTGAAGTC GATCTTATCG AGGCTAATGA AGCGTTTGCT GCACAGGCGC TTTCGGTTGG CAACATGCTT GAGTGGGATG AGCGTCGGGT CAATGTCAAT GGTGGCGCGA TCGCACTCGG TCACCCGATA GGCGCTTCCG GTTGCCGAAT CCTGGTTTCT CTGGTTCATG AAATGGTGAA ACGTAATGCC CGCAAAGGAC TGGCAACGCT TTGTATCGGC GGGGGCCAGG GTGTGGCATT GACCATTGAA CGTGACGAAT AG (SEQ ID NO:259) | RKGLATLCIG GGQGVALTIE RDE (SEQ ID NO:260) |
| murQ | predicted PTS component | atgCAATTTG AAAAGATGAT TACTGAAGGC TCGAACACCG CCTCGGCTGA AATTGACCGC GTATCGACGC TGGAAATGTG CCGGATTATC AACGATGAAG ATAAAACCGT ACCGCTTGCC GTTGAGCGCG TACTGCCGGA TATCGCCGCG GCGATCGATG TTATCCACGC CCAGGTAAGC GGCGGCGGGC GTCTGATTTA CCTCGGTGCG GGAACATCCG GTCGTCTGGG GATTCTGGAT GCCAGCGAAT GTCCGCCCAC CTACGGCGTG AAACCGGGTC TGGTGGTTGG TTTGATTGCT GGCGGCGAAT ATGCCATTCA GCACGCGGTG GAAGCGCGG AAGATAGCCG GGAAGGCGGT GTTAATGATC TGAAAAATAT TAATTTAACG GCACAGGATG TGGTGGTTGG CATTGCTGCC AGCGGTCGCA CGCCGTATGT GATTGCCGGA CTGGAATACG CACGCCAGCT CGGCTGCCGC ACAGTGGGAA TTTCCTGTAA TCCGGGGAGC GCCGTTTCAA CCACCGCTGA GTTTGCCATT ACACCGATTG TAGGTGCCGA AGTTGTTACC GGTTCTTCGC | MQFEKMITEG SNTASAEIDR VSTLEMCRII NDEDKTVPLA VERVLPDIAA AIDVIHAQVS GGGRLIYLGA GTSGRLGILD ASECPPTYGV KPGLVVGLIA GGEYAIQHAV EGAEDSREGG VNDLKNINLT AQDVVVGIAA SGRTPYVIAG LEYARQLGCR TVGISCNPGS AVSTTAEFAI TPIVGAEVVT GSSRMKAGTA QKLVLNMLST GLMIKSGKVF GNLMVDVVAT NEKLHVRQVN IVKNATGCSA FQAEAALIAC ERNCKTAIVM VLKNLDAAEA KKRLDQHGGF IRQVLDKE |

FIG. 16H

|  |  | GGATGAAAGC AGGTACAGCG<br>CAGAAACTGG TGCTCAATAT<br>GCTTTCCACC GGGCTGATGA<br>TTAAATCCGG CAAAGTGTTC<br>GGCAACCTGA TGGTCGATGT<br>GGTCGCCACC AACGAAAAAC<br>TGCATGTGCG ACAGGTCAAT<br>ATTGTTAAAA ACGCCACCGG<br>ATGTAGCGCA GAGCAAGCGG<br>AAGCGGCGTT AATTGCTTGC<br>GAGCGCAACT GTAAAACGGC<br>CATTGTGATG GTGCTGAAAA<br>ATCTCGATGC CGCAGAAGCT<br>AAAAAACGCC TGGATCAACA<br>CGGCGGCTTT ATTCGTCAGG<br>TTTTAGACAA GGAATAA (SEQ<br>ID NO:261) | (SEQ ID NO:262) |

| Source | Genbank Accession Number |
|---|---|
| Shigella boydii<br>CDC 3083-94 | YP_001881145.1 |
| Escherichia fergusonii<br>ATCC 35469 | YP_002382013.1 |
| Salmonella enterica<br>subsp. arizonae | YP_001569590.1 |
| Citrobacter sp.<br>30_2 | ZP_04562837.1 |
| Klebsiella pneumoniae<br>subsp. pneumoniae MGH 78578 | YP_001336360.1 |
| Pectobacterium carotovorum<br>subsp. carotovorum WPP14 | ZP_03831287.1 |
| Enterobacter cancerogenus<br>ATCC 35316 | ZP_03283474.1 |
| Pantoea sp. At-9b | ZP_05730617.1 |
| Cronobacter turicensis | CBA32510.1 |

FIG. 16I

| | |
|---|---|
| Dickeya dadantii Ech586 | ZP_05723897.1 |
| Erwinia tasmaniensis Et1/99 | YP_001907100.1 |
| Serratia proteamaculans 568 | YP_001479594.1 |
| Edwardsiella ictaluri 93-146 | YP_002934130.1 |
| Sodalis glossinidius str. 'morsitans' | YP_455303.1 |
| Yersinia aldovae ATCC 35236 | ZP_04620215.1 |
| Providencia stuartii ATCC 25827 | ZP_02961167.1 |
| Photorhabdus asymbiotica | YP_003040275.1 |
| Proteus mirabilis HI4320 | YP_002151524.1 |
| Candidatus Blochmannia pennsylvanicus str. BPEN | YP_278005.1 |
| Glaciecola sp. HTCC2999 | ZP_03561088.1 |
| Vibrio cholerae V51 | ZP_04919940.1 |
| Wigglesworthia glossinidia endosymbiont of Glossina brevipalpis | NP_871411.1 |
| Tolumonas auensis DSM 9187 | YP_002892770.1 |
| Actinobacillus pleuropneumoniae serovar 1 str. 4074 | ZP_00134992.2 |
| Aggregatibacter aphrophilus NJ8700 | YP_003007711.1 |
| Pseudoalteromonas tunicata D2 | ZP_01135065.1 |
| Vibrionales bacterium SWAT-3 | ZP_01816638.1 |

FIG. 16J

| Pasteurella multocida subsp. multocida str. Pm70 | NP_245276.1 |
|---|---|
| Mannheimia succiniciproducens MBEL55E | YP_088783.1 |
| Haemophilus somnus 129PT | YP_718877.1 |
| Shewanella loihica PV-4 | YP_001094535.1 |
| Aliivibrio salmonicida LFI1238 | YP_002262558.1 |

FIG. 17A

AAR_7942 sequence

**SEQ ID NO:195 - *Synechococcus elongatus* PCC7942 Synpcc7942_1594 DNA**

```
   1 atgttcggtc ttatcggtca tctcaccagt ttggagcagg cccgcgacgt ttctcgcagg
  61 atgggctacg acgaatacgc cgatcaagga ttggagtttt ggagtagcgc tcctcctcaa
 121 atcgttgatg aaatcacagt caccagtgcc acaggcaagg tgattcacgg tcgctacatc
 181 gaatcgtgtt tcttgccgga aatgctggcg gcgcgccgct tcaaaacagc cacgcgcaaa
 241 gttctcaatg ccatgtccca tgcccaaaaa cacggcatcg acatctcggc cttgggggc
 301 tttacctcga ttattttcga gaatttcgat ttggccagtt tgcggcaagt gcgcgacact
 361 accttggagt ttgaacggtt caccaccgga aatactcaca cggcctacgt aatctgtaga
 421 caggtggaag ccgctgctaa aacgctgggc atcgacatta cccaagcgac agtagcggtt
 481 gtcggcgcga ctggcgatat cggtagcgct gtctgccgct ggctcgacct caaactgggt
 541 gtcggtgatt tgatcctgac ggcgcgcaat caggagcgtt tggataacct gcaggctgaa
 601 ctcggccggg gcaagattct gcccttggaa gccgctctgc cggaagctga ctttatcgtg
 661 tgggtcgcca gtatgcctca gggcgtagtg atcgacccag caaccctgaa gcaaccctgc
 721 gtcctaatcg acggggggcta ccccaaaaac ttgggcagca aagtccaagg tgaggggcatc
 781 tatgtcctca atggcggggt agttgaacat tgcttcgaca tcgactggca gatcatgtcc
 841 gctgcagaga tggcgcggcc cgagcgccca atgtttgcct gctttgccga ggcgatgctc
 901 ttggaatttg aaggctggca tactaacttc tcctggggcc gcaaccaaat cacgatcgag
 961 aagatggaag cgatcggtga ggcatcggtg cgccacggct tccaacccct ggcattggca
1021 atttga
```

**SEQ ID NO:196 - *Synechococcus elongatus* PCC7942 Synpcc7942_1594 protein (YP_400611)**

```
   1 MFGLIGHLTS LEQARDVSRR MGYDEYADQG LEFWSSAPPQ IVDEITVTSA TGKVIHGRYI
  61 ESCFLPEMLA ARRFKTATRK VLNAMSHAQK HGIDISALGG FTSIIFENFD LASLRQVRDT
 121 TLEFERFTTG NTHTAYVICR QVEAAAKTLG IDITQATVAV VGATGDIGSA VCRWLDLKLG
 181 VGDLILTARN QERLDNLQAE LGRGKILPLE AALPEADFIV WVASMPQGVV IDPATLKQPC
 241 VLIDGGYPKN LGSKVQGEGI YVLNGGVVEH CFDIDWQIMS AAEMARPERQ MFACFAEAML
 301 LEFEGWHTNF SWGRNQITIE KMEAIGEASV RHGFQPLALA I
```

SEQ ID NO:213 – Nucleotide sequence of plasmid pCL-Ptrc-carB_'tesA

```
CACTATACCAATTGAGATGGGCTAGTCAATGATAATTACTAGTCCTTTTCCTTTGAGTTGTGGGTATCTGTAAATTCTGCTAGACC
TTTGCTGGAAAACTTGTAAATTCTGCTAGACCCTCTGTAAATTCCGCTAGACCTTTGTGTGTTTTTTTTGTTTATATTCAAGTGGT
TATAATTTATAGAATAAAGAAAGAATAAAAAAAGATAAAAAGAATAGATCCCAGCCCTGTGTATAACTCACTACTTTAGTCAGTTC
CGCAGTATTACAAAAGGATGTCGCAAACGCTGTTTGCTCCTCTACAAAACAGACCTTAAAACCCTAAAGGCgtcGGCATCCGCTTA
CAGACAAGCTGTGACCGTCTCCGGGAGCTGCATGTGTCAGAGGTTTTCACCGTCATCACCGAAACGCGCGAGGCAGCAGATCAATT
CGCGCGCGAAGGCGAAGCGGCATGCATTTACGTTGACACCATCGAATGGTGCAAAACCTTTCGCGGTATGGCATGATAGCGCCCGG
AAGAGAGTCAATTCAGGGTGGTGAATGTGAAACCAGTAACGTTATACGATGTCGCAGAGTATGCCGGTGTCTCTTATCAGACCGTT
TCCCGCGTGGTGAACCAGGCCAGCCACGTTTCTGCGAAAACGCGGGAAAAAGTGGAAGCGGCGATGGCGGAGCTGAATTACATTCC
CAACCGCGTGGCACAACAACTGGCGGGCAAACAGTCGTTGCTGATTGGCGTTGCCACCTCCAGTCTGGCCCTGCACGCGCCGTCGC
AAATTGTCGCGGCGATTAAATCTCGCGCCGATCAACTGGGTGCCAGCGTGGTGGTGTCGATGGTAGAACGAAGCGGCGTCGAAGCC
TGTAAAGCGGCGGTGCACAATCTTCTCGCGCAACGCGTCAGTGGGCTGATCATTAACTATCCGCTGGATGACCAGGATGCCATTGC
TGTGGAAGCTGCCTGCTGACTAATGTTCCGGCGTTATTTCTTGATGTCCTGACCAGACACCCATCAACAGTATTATTTTTCTCCCATG
AAGACGGTACGCGACTGGGCGTGGAGCATCTGGTCGCATTGGGTCACCAGCAAATCGCGCTGTTAGCGGCCCCATTAAGTTCTGTC
TCGGCGCGTCTGCGTCTGGCTGGCTGGCATAAATATCTCACTCGCAATCAAATTCAGCCGATAGCGGAACGGGAAGGCGACTGGAG
TGCCATGTCCGGTTTTCAACAAACCATGCAAATGCTGAATGAGGGCATCGTTCCCACTGCGATGCTGGTTGCCAACGATCAGATGG
CGCTGGGCGCAATGCGCGCCATTACCGAGTCCGGGCTGCGCGTTGGTGCGGATATCTCGGTAGTGGGATACGACGATACCGAAGAC
AGCTCATGTTATATCCCGCCGTtAACCACCATCAAACAGGATTTTCGCCTGCTGGGGCAAACCAGCGTGGACCGCTTGCTGCAACT
CTCTCAGGGCCAGGCGGTGAAGGGCAATCAGCTGTTGCCCGTCTCACTGGTGAAAAGAAAAACACCCTGGCGCCCAATACGCAAA
CCGCCTCTCCCCGCGCGTTGGCCGATTCATTAATGCAGCTGGCACGACAGGTTTCCCGACTGGAAAGCGGGCAGTGAGCGCAACGC
AATTAATGTaAGTTAGCGCGAATTGATCTGGTTTGACAGCTTATCATCGACTGCACGGTGCACCAATGCTTCTGGCGTCAGGCAGC
CATCGGAAGCTGTGGTATGGCTGTGCAGGTCGTAAATCACTGCATAATTCGTGTCGCTCAAGGCGCACTCCCGTTCTGGATAATGT
TTTTTGCGCCGACATCATAACGGTTCTGGCAAATATTCTGAAATGAGCTGTTGACAATTAATCATCCGGCTCGTATAATGTGTGGA
ATTGTGAGCGGATAACAATTTCACACAGGAAACAGCGCCGCTGAGAAAAAGCGAAGCGGCACTGCTCTTTAACAATTTATCAGACA
ATCTGTGTGGGCACTCGACCGGAATTATCGATTAACTTTATTATTAAAAATTAAAGAGGTATATATTAATGTATCGATTAAATAAG
```

FIG. 17B

```
GAGGAATAAACCATGACCAGCGATGTTCACGACGCCACAGACGGCGTCACCGAAACCGCACTCGACGACGAGCAGTCGACCCGCCG
CATCGCCCGAGCTGTACGCCACCGATCCCGAGTTCGCCGCCGCCGCACCGTTGCCCGCCGTGGTCGACGCGGCGCACAAACCCGGGC
TGCGGCTGGCAGAGATCCTGCAGACCCTGTTCACCGGCTACGGTGACCGCCCGGCGCTGGGATACCGCGCCCGTGAACTGGCCACC
GACGAGGGCGGGCGCACCGTGACGCGTCTGCTGCCGCGGTTCGACACCCTCACCTACGCCCAGGTGTGGTCGCGCGTGCAAGCGGT
CGCCGCGGCCCTGCGCCACAACTTCGCGCAGCCGATCTACCCCGGCGACGCCGTCGCGACGATCGGTTTCGCGAGTCCCGATTACC
TGACGCTGGATCTCGTATGCGCCTACCTGGGCCTCGTGAGTGTTCCGCTGCAGCACAACGCCACCGGTCAGCCGGCTCGCCCCGATC
CTGGCCGAGGTCGAACCGCGGATCCTCACCGTGAGCGCCGAATACCTCGACCTCGCAGTCGAATCCGTGCGGGACGTCAACTCGGT
GTCGCAGCTCGTGCTGTTCGACCATCACCCCGAGGTCGACGACCACCGCGACGCACTGGCCCGCGCGCGTGAACAACTCGCCGGCA
AGGGCATCGCCGTCACCACCCTGGACGCGATCGCCGACGAGGGCGCCGGGCTGCCGGCCGAACCGATCTACACCGCCGACCATGAT
CAGCGCCTCGCGATGATCCTGTACACCTCGGGTTCCACCGGCGCACCCAAGGGTGCGATGTACACCGAGGCGATGGTGGCGCGGCT
GTGGACCATGTCGTTCATCACGGGTGACCCCACGCCGGTCATCAACGTCAACTTCATGCCGCTCAACCACCTGGGCGGGCGCATCC
CCATTTCCACCGCCGTGCAGAACGGTGGAACCAGTTACTTCGTACCGGAATCCGACATGTCCACGCTGTTCGAGGATCTCGCGCTG
GTGCGCCCGACCGAACTCGGCCTGGTTCCCGCCGTCGCCGACATGCTCTACCAGCACCACCTCGCCACCGTCGACCGCCTGGTCAC
GCAGGGCGCCGACGAACTGACCGCCGAGAAGCAGGCCGGTGCCGAACTGCGTGAGCAGGTGCTCGGCGGACGCGTGATCACCGGAT
TCGTCAGCACCGCACCGCTGGCCGCGGAGATGAGGGCGTTCCTCGACATCACCCTGGGCGCACACATCGTCGACGGCTACGGGCTC
ACCGAGACCGGCGCCGTGACACGCGACGGTGTGATCGTGCGGCCACCGGTGATCGACTACAAGCTGATCGACGTTCCCGAACTCGG
CTACTTCAGCACCGACAAGCCCTACCCGCGTGGCGAACTGCTGGTCAGGTCGCAAACGCTGACTCCCGGGTACTACAAGCGCCCG
AGGTCACCGCGAGCGTCTTCGACCGGGACGGCTACTACCACACCGGCGACGTCATGGCCGGAGACCGCACCCGACCACCTGGTGTAC
GTGGACGTCGCAACAACGTCCTCAAACTCGCGCAGGGCGAGTTCGTGGCGGTCGCCAACCTGGAGGCGGTGTTCTCCGGCGCGGC
GCTGGTGCGCCAGATCTTCGTGTACGGCAACAGCGAGCGCAGTTTCCTTCTGGCCGTGGTGGTCCCGACGCCGGAGGCGCTCGAGC
AGTACGATCCGGCCGCGCTCAAGGCCGCGCTGGCCGACTCGCTGCAGCGCACCGCACGCGACGCCGAACTGCAATCCTACGAGGTG
CCGGCCGATTTCATCGTCGAGACCGAGCCGTTCAGCGCCGCCAACGGGCTGCTGTCGGGTGTCGGAAAACTGCTGCGGCCCAACCT
CAAAGACCGCTACGGGCAGCGCCTGGAGCAGATGTACGCCGATATCGCGGCCACGCAGGCCAACCAGTTGCGCGAACTGCGGCGCG
CGGCCGCCACACAACCGGTGATCGACACCCTCACCCAGGCCGCTGCCACGATCCTCGGCACCGGGAGCGAGGTGGCATCCGACGCC
CACTTCACCGACCTGGGCGGGGATTCCCTGTCGGCGCTGACACTTTCGAACCTGCTGAGCGATTTCTTCGGTTTCGAAGTTCCCGT
CGGCACCATCGTGAACCCGGCCACCAACCCTCGCCCAACTCGCCCAGCACATCGAGGCGCAGCGCACCGCGGGTGACCGCAGGCCGA
GTTTCACCACCGTGCACGGCGCGGACGCCACCGAGATCCGGGCGAGTGAGCTGACCCTGGACAAGTTCATCGACGCCGAAACGCTC
CGGGCCGCACCGGGTCTGCCCAAGGTCACCACCGAGCCACGGACGGTCGTTGCTCTCGGGCGCCAACGGCTGGCTGGGCCGGTTCCT
CACGTTGCAGTGGCTGGAACGCCTGGCACCTGTCGGCGGCACCCTCATCACGATCGTGCGGGGCCGCGACGACGCCGCGGCCCGCG
CACGGCTGACCCAGGCCTACGACACCGATCCCGAGTTGTCCCGCCGCTTCGCCGAGCTGGCCGACCGCCACCTGCGGGTGGTCGCC
GGTGACATCGGCGACCCGAATCTGGGCCTCACACCCGAGATCTGGCACCGGCTCGCCGCCGAGGTCGACCTGGTGGTGCATCCGGC
AGCGCTGGTCAACCACGTGCTCCCCTACCGGCAGCTGTTCGGCCCCAACGTCGTGGGCACGGCCGAGGTGATCAAGCTGGCCCTCA
CCGAACGGATCAAGCCCGTCACGTACCTGTCCACCGTGTCGGTGGCCATGGGGATCCCCGACTTCGAGGAGGACGGCGACATCCGG
ACCGTGAGCCCGGTGCGCCCGCTCGACGGCGGATACGCCAACGGCTACGGCAACAGCAAGTGGGCCGGCGAGGTGCTGCTGCGGGA
GGCCCACGATCTGTGCGGGCTGCCCGTGGCGACGTTCCGCTCGGACATGATCCTGGCGCATCCGCGCTACCGCGGTCAGGTCAACG
TGCCAGACATGTTCACGCGACTCCTCGTTGAGCCTCTTGATCACCGGCGTCGCGCCGCGGTCGTTCTACATCGGAGACGGTGAGCGC
CCGCGGGCGCACTACCCCGGCCTGACGGTCGATTTCGTGGCCGAGGCGGTCACGACGCTCGGCCGCCAGCAGCGCGAGGGATACGT
GTCCTACGACGTGATGAACCCGCACGACGACGGGATCTCCCTGCATGTGTTCGTGGACTGGCTGATCCGGGCGGGCCATCCGATCG
ACCGGGTCGACGACTACGACGACTGGGTGCGTCGGTTCGAGACCGCGTTGACCGCGCTTCCCGAGAAGCGCCGCGCACAGACCGTA
CTGCCGCTGCTGCACGCGTTCCGCGCTCCGCAGGCACCGTTGCGCGGCGCACCCGAACCCACGGAGGTGTTCCACGCCGCGGTGCG
CACCGCGAAGGTGGGCCCGGGAGACATCCCGCACCTCGACGAGGCGCTGATCGACAAGTACATACGCGATCTGCGTGAGTTCGGTC
TGATCTGAGAATTCTAGATCTGATCGTTGCGGGCGGGGCGAGAGTCTCGCCCCGCCCGCGACCGCGGTGAAAATACGAGAATATTA
TTTGTATTGATCTCCTAGGCGGGGTACCGTATTTTGGATGATAACGAGGCGCAAAAAATGGCGGACACGTTATTGATTCTGGGTGA
TAGCCTGAGCGCCGGGTATCGAATGTCTGCCAGCGCGGCCTGGCCTGCCTTCTTGAATGATAAGTGGCAGAGTAAAACGTCGGTAG
TTAATGCCAGCATCAGCGGCGACACCTCGCAACAAGGACTGGCGCGCCTTCCGGCTCTGCTGAAACAGCATCAGCCGCGTTGGGTG
CTGGTTGAACTGGGCGGCAATGACGGTTTGCGTGGTTTTCAGCCACAGCAAACCGAGCAAACGCTGCGCCAGATTTTGCAGGATGT
CAAAGCCGCCAACGCTGAACCATTGTTAATGCAAATACGTCTGCCTGCAAACTATGGTCGCCGTTATAATGAAGCCTTTAGCGCCA
TTTACCCCAAACTCGCCAAAGAGTTTGATGTTCCGCTGCTGCCCTTTTTTATGGAAGAGGTCTACCTCAAGCCACAATGGATGCAG
GATGACGGTATTCATCCCAACCGCGACGCCCAGCCGTTTATTGCCGACTGGATGGCGAAGCAGTTGCAGCCTTTAGTAAATCATGA
CTCATAActagggtaccgctagcgagctctctagaGAAGCTTGGGCCCGAACAAAAACTCATCTCAGAAGAGGATCTGAATAGC
GCCGTCGACCATCATCATCATCATTGAGTTTAAACGGTCTCCAGCTTGGCTGTTTTGGCGGATGAGAGAAGATTTTCAGCCTG
ATACAGATTAAATCAGAACGCAGAAGCGGTCTGATAAAACAGAATTTGCCTGGCGGCAGTAGCGCGGTGGTCCCACCTGACCCCAT
GCCGAACTCAGAAGTGAAACGCCGTAGCGCCGATGGTAGTGTGGGGTCTCCCATGCGAGAGTAGGGAACTGCCAGGCATCAAATA
AAACGAAAGGCTCAGTCGAAAGACTGGGCCTTTCGTTTTATCTGTTGTTTGTCGGTGAACGCTCTCCTgacGCCTGATGCGGTATT
TTCTCCTTACGCATCTGTGCGGTATTTCACACCGCATATGGTGCACTCTCAGTACAATCTGCTCTGATGCCGCATAGTTAAGCCAG
CCCCGACACCCGCCAACACCCGCTGACGAGCTTAGTAAAGCCCTCGCTAGATTTTAATGCGGATGTTGCGATTACTTCGCCAACTA
TTGCGATAACAAGAAAAAGCCAGCCTTTCATGATATATCTCCCAATTTGTGTAGGGCTTATTATGCACGCTTAAAAATAATAAAAG
CAGACTTGACCTGATAGTTTGGCTGTGAGCAATTATGTGCTTAGTGCATCTAACGCTTGAGTTAAGCCGCGCCGCGAAGCGGCGTC
GGCTTGAACGAATTGTTAGACATTATTTGCCGACTACCTTGGTGATCTCGCCTTTCACGTAGTGGACAAATTCTTCCAACTGATCT
GCGCGCGAGGCCAAGCGATCTTCTTCTTGTCCAAGATAAGCCTGTCTAGCTTCAAGTATGACGGGCTGATACTGGGCCGGCAGGCG
CTCCATTGCCCAGTCGGCAGCGACATCCTTCGGCGCGATTTTGCCGGTTACTGCGCTGTACCAAATGCGGGACAACGTAAGCACTA
```

FIG. 17C

```
CATTTCGCTCATCGCCAGCCCAGTCGGGCGGCGAGTTCCATAGCGTTAAGGTTTCATTTAGCGCCTCAAATAGATCCTGTTCAGGA
ACCGGATCAAAGAGTTCCTCCGCCGCTGGACCTACCAAGGCAACGCTATGTTCTCTTGCTTTTGTCAGCAAGATAGCCAGATCAAT
GTCGATCGTGGCTGGCTCGAAGATACCTGCAAGAATGTCATTGCGCTGCCATTCTCCAAATTGCAGTTCGCGCTTAGCTGGATAAC
GCCACGGAATGATGTCGTCGTGCACAACAATGGTGACTTCTACAGCGCGGAGAATCTCGCTCTCTCCAGGGGAAGCCGAAGTTTCC
AAAAGGTCGTTGATCAAAGCTCGCCGCGTTGTTTCATCAAGCCTTACGGTCACCGTAACCAGCAAATCAATATCACTGTGTGGCTT
CAGGCCGCCATCCACTGCGGAGCCGTACAAATGTACGGCCAGCAACGTCGGTTCGAGATGGCGCTCGATGACGCCAACTACCTCTG
ATAGTTGAGTCGATACTTCGGCGATCACCGCTTCCCTCATGATGTTTAACTTTCTTTTAGGGCGACTGCCCTGCTGCGTAACATCG
TTGCTGCTCCATAACATCAAACATCGACCCACGGCGTAACGCGCTTGCTGCTTGGATGCCCGAGGCATAGACTGTACCCCAAAAAA
ACAGTCATAACAAGCCATGAAAACCGCCACTGCCGCCGTTACCACCGCTGCGTTCGGTCAAGGTTCTGGACCAGTTGCGTGAGCGCA
TACGCTACTTGCATTACAGCTTACGAACCGAACAGGCTTATGTCCACTGGGTTCGTGCCTTCATCCGTTTCCACGGTGTGCGTCAC
CCGGCAACCTTGGGCAGCAGCGAAGTCGAGGCATTTCTGTCCTGGCTGGCGAACGAGCGCAAGGTTTCGGTCTCCACGCATCGTCA
GGCATTGGCGGCCTTGCTGTTCTTCTACGGCAAGGTGCTGTGCACGGATCTGCCCTGGCTTCAGGAGATCGGAAGACCTCGGCCGT
CGCGGCGCTTGCCGGTGGTGCTGACCCCGGATGAAGTGGTTCGCATCCTCGGTTTTCTGGAAGGCGAGCATCGTTTGTTCGCCCAG
CTTCTGTATGGAACGGGCATGCGGATCAGTGAGGGTTTGCAACTGCGGGTCAAGGATCTGGATTTCGATCACGGCACGATCATCGT
GCGGGAGGGCAAGGGCTCCAAGGATCGGGCCTTGATGTTACCCGAGAGCTTGGCACCCAGCCTGCGCGAGCAGGGGAATTAATTCC
CACGGTTTTGCCCGCCAAACGGGCTGTTCTGGTGTTGCTAGTTTGTTATCAGAATCGCAGATCCCGCTTCAGCCGGTTTGCCG
GCTGAAAGCGCTATTTCTTCCAGAATTGCCATGATTTTTTCCCCACGGGAGGCGTCACTGGCTCCCGTGTTGTCGGCAGCTTTGAT
TCGATAAGCAGCATCGCCTGTTTCAGGCTGTCTATGTGTGACTGTTGAGCTGTAACAAGTTGTCTCAGGTGTTCAATTTCATGTTC
TAGTTGCTTTGTTTTACTGGTTTCACCTGTTCTATTAGGTGTTACATGCTGTTCATCTGTTACATTGTCGATCTGTTCATGGTGAA
CAGCTTTGAATGCACCAAAAACTCGTAAAAGCTCTGATGTATCTATCTTTTTTACACCGTTTTCATCTGTGCATATGGACAGTTTT
CCCTTTGATATGTAACGGTGAACAGTTGTCTACTTTTGTTTGTTAGTCTTGATGCTTCACTGATAGATACAAGAGGCCATAAGAAC
CTCAGATCCTTCCGTATTTAGCCAGTATGTTCTCTAGTGTGGTTCGTTGTTTTTGCGTGAGCCATGAGAACGAACCATTGAGATCA
TACTTACTTTGCATGTCACTCAAAAATTTTGCCTCAAAACTGGTGAGCTGAATTTTTGCAGTTAAAGCATCGTGTAGTGTTTTTCT
TAGTCCGTTATGTAGGTAGGAATCTGATGTAATGGTTGTTGGTATTTTGTCACCATTCATTTTTATCTGGTTGTTCTCAAGTTCGG
TTACGAGATCCATTTGTCTATCTAGTTCAACTTGGAAAATCAACGTATCAGTCGGGCGGCCTCGCTTATCAACCACCAATTTCATA
TTGCTGTAAGTGTTTAAATCTTTACTTATTGGTTTCAAAACCCATTGGTTAAGCCTTTTAAACTCATGGTAGTTATTTTCAAGCAT
TAACATGAACTTAAATTCATCAAGGCTAATCTCTATATTTGCCTTGTGAGTTTTCTTTTGTGTTAGTTCTTTTAATAACCACTCAT
AAATCCTCATAGAGTATTTGTTTTCAAAAGACTTAACATGTTCCAGATTATATTTTATGAATTTTTTTAACTGGAAAAGATAAGGC
AATATCTCTTCACTAAAAACTAATTCTAATTTTTCGCTTGAGAACTTGGCATAGTTTGTCCACTGGAAAATCTCAAAGCCTTTAAC
CAAAGGATTCCTGATTTCCACAGTTCTCGTCATCAGCTCTCTGGTTGCTTTAGCTAATACACCATAAGCATTTTCCCTACTGATGT
TCATCATCTGAGCGTATTGGTTATAAGTGAACGATACCGTCCGTTCTTTCCTTGTAGGGTTTTCAATCGTCGGGTTGAGTAGTGCC
ACACAGCATAAAATTAGCTTGGTTTCATGCTCCGTTAAGTCATAGCGACTAATCGCTAGTTCATTTGCTTTGAAAACAACTAATTC
AGACATACATCTCAATTGGTCTAGGTGATTTTAAT
```

TER *Euglena gracilis* (Q5EU90) without N-terminal transit peptide

Amino acid sequence (SEQ ID NO:228)

```
  1 vpqmaegfsg eatsawaaag pqwaaplvaa assalalwww aarrsvrrpl aalaelptav
 61 thlappmamf tttakviqpk irgficttth pigcekrvqe eiayarahpp tspgpkrvlv
121 igcstgygls tritaafgyq aatlgvflag pptkgrpaaa gwyntvafek aaleaglyar
181 slngdafdst tkartveaik rdlgtvdlvv ysiaapkrtd patgvlhkac lkpigatytn
241 rtvntdkaev tdvsiepasp eeiadtvkvm ggedwelwiq alseagvlae gaktvaysyi
301 gpemtwpvyw sgtigeakkd vekaakritq qygcpaypvv akalvtqass aipvvplyic
361 llyrvmkekg thegcieqmv rllttklype ngapivdeag rvrvddwema edvqqavkdl
421 wsqvstanlk disdfagyqt eflrlfgfgi dgvdydqpvd veadlpsaaq q
``` fadA (YP026272)

Nucleotide sequence (SEQ ID NO:229)

```
  1 atggaacagg ttgtcattgt cgatgcaatt cgcacccga tgggccgttc gaagggcggt
 61 gctttttcgta acgtgcgtgc agaagatctc tccgctcatt taatgcgtag cctgctggcg
121 cgtaacccgg cgctggaagc ggcggccctc gacgatattt actggggttg tgtgcagcag
181 acgctggagc agggttttaa tatcgcccgt aacgcggcgc tgctggcaga agtaccacac
241 tctgtcccgg cggttaccgt taatcgcttg tgtggttcat ccatgcaggc actgcatgac
```

FIG. 17D

```
 301 gcagcacgaa tgatcatgac tggcgatgcg caggcatgtc tggttggcgg cgtggagcat
 361 atgggccatg tgccgatgag tcacggcgtc gattttcacc ccggcctgag ccgcaatgtc
 421 gccaaagcgg cgggcatgat gggcttaacg gcagaaatgc tggcgcgtat gcacggtatc
 481 agccgtgaaa tgcaggatgc ctttgccgcg cggtcacacg cccgcgcctg ggccgccacg
 541 cagtcggccg catttaaaaa tgaaatcatc ccgaccggtg gtcacgatgc cgacggcgtc
 601 ctgaagcagt ttaattacga cgaagtgatt cgcccggaaa ccaccgtgga agccctcgcc
 661 acgctgcgtc cggcgtttga tccagtaaac ggtatggtaa cggcgggcac atcttctgca
 721 ctttccgatg gcgcagctgc catgctggtg atgagtgaaa gccgcgccca tgaattaggt
 781 cttaagccgc gcgctcgtgt gcgttcgatg gcggtcgttg gttgtgaccc atcgattatg
 841 ggttacggcc cggttccggc ctcgaaactg gcgctgaaaa aagcgggggct ttctgccagc
 901 gatatcggcg tgtttgaaat gaacgaagcc tttgccgcgc agatcctgcc atgtattaaa
 961 gatctggac taattgagca gattgacgag aagatcaacc tcaacggtgg cgcgatcgcg
1021 ctgggtcatc cgctggggttg ttccggtgcg cgtatcagca ccacgctgct gaatctgatg
1081 gaacgcaaag acgttcagtt tggtctggcg acgatgtgta tcggtctggg tcaggtatt
1141 gcgacggtgt tgagcgggt taa
```

Amino acid sequence (SEQ ID NO:230)

```
  1 meqvvivdai rtpmgrskgg afrnvraedl sahlmrslla rnpalcaaal ddiywgcvqq
 61 tleqgfniar naallaevph svpavtvnrl cgssmqalhd aarmimtgda qaclvggveh
121 mghvpmshgv dfhpglsrnv akaagmmglt aemlarmhgi sremqdafaa rsharawaat
181 qsaafkneii ptgghdadgv lkqfnydevi rpettveala tlrpafdpvn gmvtagtssa
241 lsdgaaamlv msesrahelg lkprarvrsm avvgcdpsim gygpvpaskl alkkaglsas
301 digvfemnea faaqilpcik dlglieqide kinlnggaia lghplgcsga risttllnlm
361 erkdvqfgla tmciglgqgi atvferv
``` fadB (NP 416843)

Nucleotide sequence (SEQ ID NO:231)

```
   1 atgctttaca aaggcgacac cctgtacctt gactggctgg aagatggcat tgccgaactg
  61 gtatttgatg ccccaggttc agttaataaa ctcgacactg cgaccgtcgc cagcctcggc
 121 gaggccatcg gcgtgctgga acagcaatca gatctaaaag ggctgctgct gcgttcgaac
 181 aaagcagcct ttatcgtcgg tgctgatatc accgaatttt tgtccctgtt cctcgttcct
 241 gaagaacagt taagtcagtg gctgcacttt gccaatagcg tgtttaatcg cctggaagat
 301 ctgccggtgc cgaccattgc tgccgtcaat ggctatgcgc tgggcggtgg ctgcgaatgc
 361 gtgctggcga ccgattatcg tctggcgacg ccggatctgc gcatcggtct gccggaaacc
 421 aaactgggca tcatgcctgg ctttggcggt tctgtacgta tgccacgtat gctgggcgct
 481 gacagtgcgc tggaaatcat tgccgccggt aaagatgtcg gcgcggatca ggcgctgaaa
 541 atcggtctgg tggatgcgt agtcaaagca gaaaaactgg ttgaaggcgc aaaggcggtt
 601 ttacgccagg ccattaacgg cgacctcgac tggaaagcaa acgtcagcc gaagctggaa
 661 ccactaaaac tgagcaagat tgaagccacc atgagcttca ccatcgctaa agggatggtc
 721 gcacaaacag cggggaaaca ttatccggcc ccatcaccg cagtaaaaac cattgaagct
 781 gcggccgtt tggtcgtga agaagcctta aacctggaaa caaaagttt tgtcccgctg
 841 gcgcatacca cgaagcccg cgcactggtc ggcattttcc ttaacgatca atatgtaaaa
 901 ggcaaagcga gaaactcac caaagacgtt gaaaccccga acaggccgc ggtgctgggt
 961 gcaggcatta tgggcggcgg catcgcttac cagtctgcgt ggaaggcgt gccggttgtc
1021 atgaaagata tcaacgacaa gtcgttaacc ctcggcatga ccgaagccgc gaaactgctg
1081 aacaagcagc ttgagcgcgg caagatcgat ggtctgaaac tggctggcgt gatctccaca
1141 atccacccaa cgctcgacta cgccggattt gaccgcgtgg atattgtggt agaagcggtt
1201 gttgaaaacc cgaaagtgaa aaaagccgta ctggcagaaa ccgaacaaaa agtacgccag
1261 gataccgtgc tggcgtctaa cacttcaacc attcctatca gcgaactggc caacgcgctg
```

FIG. 17E

```
1321 gaacgcccgg aaaacttctg cgggatgcac ttctttaacc cggtccaccg aatgccgttg
1381 gtagaaatta ttcgcggcga gaaaagctcc gacgaaacca tcgccgaaagt tgtcgcctgg
1441 gcgagcaaga tgggcaagac gccgattgtg gttaacgact gccccggctt ctttgttaac
1501 cgcgtgctgt tcccgtattt cgccggtttc agccagctgc tgcgcgacgg cgcggatttc
1561 cgcaagatcg acaaagtgat ggaaaaacag tttggctggc cgatgggccc ggcatatctg
1621 ctggacgttg tgggcattga taccgcgcat cacgctcagg ctgtcatggc agcaggcttc
1681 ccgcagcgga tgcagaaaga ttaccgcgat gccatcgacg cgctgtttga tgccaaccgc
1741 tttggtcaga gaacggcct cggtttctgg cgttataaag aagacagcaa aggtaagccg
1801 aagaaagaag aagacgccgc cgttgaagac ctgctggcag aagtgagcca gccgaagcgc
1861 gatttcagcg aagaagagat tatcgcccgc atgatgatcc cgatggtcaa cgaagtggtg
1921 cgctgtctgg aggaaggcat tatcgccact ccggcggaag cggatatggc gctggtctac
1981 ggcctgggct tcctccgtt ccacgcggg cgttccgct ggctggacac cctcggtagc
2041 gcaaatacc tcgatatggc acagcaatat cagcacctcg gcccgctgta tgaagtgccg
2101 gaaggtctgc gtaataaagc gcgtcataac gaaccgtact atcctccggt tgagccagcc
2161 cgtccggttg gcgacctgaa aacggcttaa
```

Amino acid sequence (SEQ ID NO:232)
```
  1 mlykgdtlyl dwledgiael vfdapgsvnk ldtatvaslg eaigvleqqs dlkglllrsn
 61 kaafivgadi teflslflvp eeqlsqwlhf ansvfnrled lpvptiaavn gyalgggcec
121 vlatdyrlat pdlriglpet klgimpgfgg svrmprmlga dsaleiiaag kdvgadqalk
181 iglvdgvvka eklvegakav lrqaingdld wkakrqpkle plklskieat msftiakgmv
241 aqtagkhypa pitavktiea aarfgreeal nlenksfvpl ahtnearalv giflndqyvk
301 gkakkltkdv ctpkqaavlg agimggglay qsawkgvpvv mkdindkslt lgmteaakll
361 nkqlergkid glklagvist ihptldyagf drvdivveav venpkvkkav laeteqkvrq
421 dtvlasntst ipiselanal erpcnfcgmh ffnpvhrmpl veiirgekss detiakvvaw
481 askmgktpiv vndcpgffvn rvlfpyfagf sqllrdgadf rkidkvmekg fgwpmgpayl
541 ldvvgidtah haqavmaagf pqrmqkdyrd aidalfdanr fgqknglgfw rykedskgkp
601 kkeedaaved llaevsqpkr dfseeeiiar mmipmvnevv rcleegiiat paeadmalvy
661 glgfppfhgg afrwldtlgs akyldmaqqy qhlgplyevp eglrnkarhn epyyppvepa
721 rpvgdlkta
``` fadI (NP 416844)

Nucleotide sequence (SEQ ID NO:233)
```
   1 atgggtcagg ttttaccgct ggttacccgc cagggcgatc gtatcgccat tgttagcggt
  61 ttacgtacgc cttttgcccg tcaggcgacg gcttttcatg gcattcccgc ggttgattta
 121 gggaagatgg tggtaggcga actgctggca cgcagcgaga tccccgccga agtgattgaa
 181 caactggtct ttggtcaggt cgtacaaatg cctgaagccc caacattgc gcgtgaaatt
 241 gttctcggta cgggaatgaa tgtacatacc gatgcttaca gcgtcagccg cgcttgcgct
 301 accagttcc aggcagttgc aaacgtcgca gaaagcctga tggcgggaac tattcgagcg
 361 gggattgccg gtgggcaga ttcctcttcg gtattgccaa ttggcgtcag taaaaaactg
 421 gcgcgcgtgc tggttgatgt caacaaagct cgtaccatga gccagcgact gaaactcttc
 481 tctcgcctgc gtttcgcgcga cttaatgccc gtaccacctg cggtagcaga atattctacc
 541 ggcttgcgga tgggcgacac cgcagagcaa atggcgaaaa cctacggcat cacccgagaa
 601 cagcaagatg cattagcgca ccgttcgcat cagcgtgccg ctcaggcatg gtcagacgga
 661 aaactcaaag aagaggtgat gactgccttt atccctcctt ataaacaacc gcttgtcgaa
 721 gacaacaata ttcgcgtaa ttcctcgctt gccgattacg caaagctgcg cccggcgttt
 781 gatcgcaaac acggaacggt aacggcggca aacagtacgc cgctgaccga tggcgcggca
 841 gcggtgatcc tgatgactga atcccgggcg aaagaattag gctggtgcc gctggggtat
 901 ctgcgcagct acgcatttac tgcgattgat gtctggcagg acatgttgct cggtccagcc
 961 tggtcaacac cgctggcgct ggagcgtgcc ggtttgacga tgagcgatct gacattgatc
1021 gatatgcacg aagcctttgc agctcagacg ctggcgaata ttcagttgct gggtagtgaa
1081 cgttttgctc gtgaagcact ggggcgtgca catgccactg gcgaagtgga cgatagcaaa
```

FIG. 17F

```
1141 tttaacgtgc ttggcggttc gattgcttac gggcatccct tcgcggcgac cggcgcgcgg
1201 atgattaccc agacattgca tgaacttcgc cgtcgcggcg gtggatttgg tttagttacc
1261 gcctgtgctg ccggtgggct tggcgcggca atggttctgg aggcggaata a
```

Amino acid sequence (SEQ ID NO:234)
```
  1 mgqvlplvtr qgdriaivsg lrtpfarqat afhgipavdl gkmvvgella rseipaevie
 61 qlvfgqvvqm peapniarei vlgtgmnvht daysvsraca tsfqavanva eslmagtira
121 giaggadsss vlpigvskkl arvlvdvnka rtmsqrlklf srlrlrdlmp vppavaeyst
181 glrmgdtaeq maktygitre qqdalahrsh qraaqawsdg klkeevmtaf ippykqplve
241 dnnirgnssl adyaklrpaf drkhgtvtaa nstpltdgaa avilmtesra kelglvplgy
301 lrsyaftaid vwqdmllgpa wstplalera gltmsdltli dmheafaaqt laniqllgse
361 rfarealgra hatgevddsk fnvlggsiay ghpfaatgar mitqtlhelr rrgggfglvt
421 acaaqqlgaa mvleac
``` fadJ (NP_416843)

Nucleotide sequence (SEQ ID NO:235)
```
   1 atggaaatga catcagcgtt tacccttaat gttcgtctgg acaacattgc cgttatcacc
  61 atcgacgtac cgggtgagaa aatgaatacc ctgaaggcgg agtttgcctc gcaggtgcgc
 121 gccattatta agcaactccg tgaaaacaaa gagttgcgag gcgtggtgtt tgtctccgct
 181 aaaccggaca acttcattgc tggcgcagac atcaacatga tcggcaactg caaaacggcg
 241 caagaagcgg aagctctggc gcggcagggc caacagttga tggcggagat tcatgctttg
 301 cccattcagg ttatcgcggc tattcatggc gcttgcctgg gtggtgggct ggagttggcg
 361 ctggcgtgcc acggtcgcgt ttgtactgac gatcctaaaa cggtgctcgg tttgcctgaa
 421 gtacaacttg gattgttacc cggttcaggc ggcacccagc gtttaccgcg tctgataggc
 481 gtcagcacag cattagagat gatcctcacc ggaaaacaac ttcgggcgaa acaggcatta
 541 aagctggggc tggtggatga cgttgttccg cactccattc tgctggaagc cgctgttgag
 601 ctggcaaaga aggagcgccc atcttcccgc cctctacctg tacgcgagcg tattctggcg
 661 gggccgttag gtcgtgcgct gctgttcaaa atggtcggca agaaaacaga acacaaaact
 721 caaggcaatt atccggcgac agaacgcatc ctggaggttg ttgaaacggg attagcgcag
 781 ggcaccagca gcggttatga cgccgaagct cgggcgtttg gcgaactggc gatgacgcca
 841 caatcgcagg cgctgcgtag tatcttttt gccagtacgg acgtgaagaa agatcccggc
 901 agtgatgcgc cgcctgcgcc attaaacagc gtggggattt taggtggtgg cttgatgggc
 961 ggcggtattg cttatgtcac tgcttgtaaa gcggggattc cggtcagaat taaagatatc
1021 aacccgcagg gcataaatca tgcgctgaag tacagttggg atcagctgga gggcaaagtt
1081 cgccgtcgtc atctcaaagc cagcgaacgt gacaaacagc tggcattaat ctccggaacg
1141 acggactatc gcggctttgc ccatcgcgat ctgattattg aagcggtgtt tgaaaatctc
1201 gaattgaaac aacagatggt ggcggaagtt gagcaaaatt gcgcgctca taccatcttt
1261 gcttcgaata cgtcatcttt accgattggt gatatcgccg ctcacgccac gcgacctgag
1321 caagttatcg gcctgcattt cttcagtccg gtggaaaaaa tgccgctggt ggagattatt
1381 cctcatgcgg ggacatcggc gcaaaccatc gctaccacag taaaactggc gaaaaaacag
1441 ggtaaaacgc caattgtcgt gcgtgacaaa ccggttttt acgtcaatcg catcttagcg
1501 ccttacatta atgaagctat ccgcatgttg acccaaggtg aacgggtaga gcacattgat
1561 gccgcgctag tgaaatttgg ttttccggta ggcccaatcc aacttttgga tgaggtagga
1621 atcgacaccg ggactaaaat tattcctgta ctggaagccg cttatggaga acgttttagc
1681 gcgcctgcaa atgttgtttc ttcaattttg aacgacgatc gcaaaggcag aaaaaatggc
1741 cggggtttct atctttatgg tcagaaaggg cgtaaaagca aaaaacaggt cgatcccgcc
1801 atttacccgc tgattggcac acaagggcag gggcgaatct ccgcaccgca ggttgctgaa
1861 cggtgtgtga tgttgatgct gaatgaagca gtacgttgtg ttgatgagca ggttatccgt
1921 agcgtgcgtg acggggatat tggcgcggta tttggcattg gttttccgcc atttctcggt
1981 ggaccgttcc gctatatcga ttctctcggc gcgggcgaag tggttgcaat aatgcaacga
2041 cttgccacgc agtatggttc ccgttttacc ccttgcgagc gtttggtcga gatgggcgcg
2101 cgtgggaaag ttttgaaa aacaactgca actgacctgc aataa
```

FIG. 17G

Amino Acid sequence (SEQ ID NO:236)
```
  1 memtsaftln vrldniavit idvpgekmnt lkaefasqvr aiikqlrenk elrgvvfvsa
 61 kpdnfiagad inmignckta qeaealarqg qqlmaeihal piqviaaihg aclggglela
121 lachgrvctd dpktvlglpe vqlgllpgsg gtqrlprlig vstalemilt gkqlrakqal
181 klglvddvvp hsilleaave lakkerpssr plpvrerila gplgrallfk mvgkktchkt
241 qgnypateri levvetglaq gtssgydaea rafgelamtp qsqalrsiff astdvkkdpg
301 sdappaplns vgilggglmg ggiayvtack agipvrikdi npqginhalk yswdqleqkv
361 rrrhlkaser dkqlalisgt tdyrgfahrd liieavfenl elkqqmvaev eqncaahtif
421 asntsslpig diaahatrpe qviglhffsp vekmplveii phagtsaqti attvklakkq
481 gktpivvrdk agfyvnrila pyineairml tqgervehid aalvkfgfpv gpiqlldevg
541 idtgtkiipv leaaygerfs apanvvssil nddrkgrkng rgfylygqkg rkskkqvdpa
601 iypligtqgq grisapqvae rcvmlmlnea vrcvdeqvir svrdgdiqav fgigfppflg
661 gpfryidslg agevvaimqr latqygsrft pcerlvemga rgesfwktta tdlq
``` fabI (NP 415804)

Nucleotide sequence (SEQ ID NO:237)
```
  1 atgggttttc tttccggtaa gcgcattctg gtaaccggtg ttgccagcaa actatccatc
 61 gcctacggta tcgctcaggc gatgcaccgc gaaggagctg aactggcatt cacctaccag
121 aacgacaaac tgaaaggccg cgtagaagaa tttgccgctc aattgggttc tgacatcgtt
181 ctgcagtgcg atgttgcaga agatgccagc atcgacacca tgttcgctga actggggaaa
241 gtttggccga aatttgacgg tttcgtacac tctattggtt ttgcacctgg cgatcagctg
301 gatggtgact atgttaacgc cgttaccegt gaaggcttca aaattgccca cgacatcagc
361 tcctacagct tcgttgcaat ggcaaaagct gccgctcca tgctgaatcc gggttctgcc
421 ctgctgaccc tttcctacct tggcgctgag cgcgctatcc gaactacaa cgttatgggt
481 ctggcaaaag cgtctctgga agcgaacgtg cgctatatgg cgaacgcgat gggtccggaa
541 ggtgtgcgtg ttaacgccat ctctgctggt ccgatccgta tctctggcgg ctccggtatc
601 aaagacttcc gcaaaatgct ggctcattgc gaagccgtta ccccgattcg cogtaccgtt
661 actattgaag atgtgggtaa ctctgcggca ttcctgtgct ccgatctctc tgccggtatc
721 tccggtgaag tggtccacgt tgacggcggt ttcagcattg ctgcaatgaa cgaactcgaa
781 ctgaaataa
```

Amino acid sequence (SEQ ID NO:238)
```
  1 mgflsgkril vtgvasklsi aygiaqamhr egaelaftyq ndklkgrvee faaqlgsdiv
 61 lqcdvaedas idtmfaelgk vwpkfdgfvh sigfapgdql dgdyvnavtr egfkiahdis
121 sysfvamaka crsmlnpgsa lltlsylgae raipnynvmg lakasleanv rymanamgpe
181 gvrvnaisag pirtlaasgi kdfrkmlahc eavtpirrtv tiedvgnsaa flcsdlsagi
241 sgevvhvdgg fsiaamnele lk
``` tesB (NP 414986)

Nucleotide sequence (SEQ ID NO:239)
```
  1 atgagtcagg cgctaaaaaa tttactgaca ttgttaaatc tggaaaaaat tgaggaagga
 61 ctctttcgcg gccagagtga agatttaggt ttacgccagg tgtttggcgg ccaggtcgtg
121 ggtcaggcct tgtatgctgc aaaagagacc gtccctgaag agcggctggt acattcgttt
181 cacagctact tcttcgccc tggcgatagt aagaagccga ttatttatga tgtcgaaacg
241 ctgcgtgacg gtaacagctt cagcgccgc cgggttgctg ctattcaaaa cggcaaacg
301 atttttata tgactgcctc tttccaggca ccagaagcgg gtttcgaaca tcaaaaaaca
361 atgccgtccg cgccagcgcc tgatggcctc ccttcggaaa cgcaaatcgc caatcgctg
421 gcgcacctgc tgccgccagt gctgaaagat aaattcatct gcgatcgtcc gctggaagtc
481 cgtccggtgg agtttcataa cccactgaaa ggtcacgtcg cagaaccaca tgtcaggtg
541 tggatccgcg caaatggtag cgtgccggat gacctgcgcg ttcatcagta tctgctcggt
601 tacgcttctg atcttaactt cctgccggta gctctacagc cgcacggcat cggttttctc
```

FIG. 17H

```
    661 gaaccgggga ttcagattgc caccattgac cattccatgt ggttccatcg cccgtttaat
    721 ttgaatgaat ggctgctgta tagcgtggag agcacctcgg cgtccagcgc acgtggcttt
    781 gtgcgcggtg agttttatac ccaagacggc gtactggttg cctcgaccgt tcaggaaggg
    841 gtgatgcgta atcacaatta a
```

Amino acid sequence (SEQ ID NO:240)

```
      1 msqalknllt llnlekieeg lfrgqsedlg lrqvfggqvv gqalyaaket vpeerlvhsf
     61 hsyflrpgds kkpiiydvet lrdgnsfsar rvaaiqngkp ifymtasfqa peagfchqkt
    121 mpsapapdgl psetqiaqsl ahllppvlkd kficdrplev rpvefhnplk ghvaephrqv
    181 wirangsvpd dlrvhqyllg yasdlnflpv alqphgigfl epgiqiatid hsmwfhrpfn
    241 lnewllysve stsassargf vrgefytqdg vlvastvqeg vmrnhn
```

Acr1 Acinetobacter (YP 047869)

Nucleotide sequence (SEQ ID NO:241)

```
      1 TTGATATCAA TCAGGGAAAA ACGCGTGAAC AAAAAACTTG AAGCTCTCTT CCGAGAGAAT
     61 GTAAAAGGTA AAGTGGCTTT GATCACTGGT GCATCTAGTG GAATCGGTTT GACGATTGCA
    121 AAAAGAATTG CTGCGGCAGG TGCTCATGTA TTATTGGTTG CCCGAACCCA AGAAACACTG
    181 GAAGAAGTGA AAGCTGCAAT TGAACAGCAA GGGGGACAGG CCTCTATTTT TCCTTGTGAC
    241 CTGACTGACA TGAATGCGAT TGACCAGTTA TCACAACAAA TTATGGCCAG TGTCGATCAT
    301 GTCGATTTCC TGATCAATAA TGCAGGGCGT TCGATTCGCC GTGCCGTACA CGAGTCGTTT
    361 GATCGCTTCC ATGATTTTGA ACGCACCATG CAGCTGAATT ACTTTGGTGC GGTACGTTTA
    421 GTGTTAAATT TACTGCCACA TATGATTAAG CGTAAAAATG CCAGATCAT CAATATCAGC
    481 TCTATTGGTG TATTGGCCAA TGCGACCCGT TTTTCTGCTT ATGTCGCGTC TAAAGCTGCG
    541 CTGGATGCCT TCAGTCGCTG TCTTTCAGCC GAGGTACTCA AGCATAAAAT CTCAATTACC
    601 TCGATTTATA TGCCATTGGT GCGTACCCCA ATGATCGCAC CCACCAAAAT TTATAAATAC
    661 GTGCCCACGC TTTCCCCAGA AGAAGCCGCA GATCTCATTG TCTACGCCAT TGTGAAACGT
    721 CCAAAACGTA TTGCGACGCA CTTGGGTCGT CTGGCGTCAA TTACCTATGC CATCGCACCA
    781 GACATCAATA ATATTCTGAT GTCGATTGGA TTTAACCTAT TCCCAAGCTC AACGGCTGCA
    841 CTGGGTGAAC AGGAAAAATT GAATCTGCTA CAACGTGCCT ATGCCCGCTT GTTCCCAGGC
    901 GAACACTGGT AA
```

Amino acid sequence (SEQ ID NO:242)

```
      1 misirekrvn kklealfren vkgkvalitg assgigltia kriaaagahv llvartqetl
     61 eevkaaieqq ggqasifpcd ltdmnaidql sqqimasvdh vdflinnagr sirravhesf
    121 drfhdfertm qlnyfgavrl vlnllphmik rkngqiinis sigvlanatr fsayvaskaa
    181 ldafsrclsa evlkhkisit siymplvrtp miaptkiyky vptlspeeaa dlivyaivkr
    241 pkriathlgr lasityaiap dinnilmsig fnlfpsstaa lgeqeklnll qrayarlfpg
    301 ehw
```

METHODS AND COMPOSITIONS FOR PRODUCING FATTY ALCOHOLS

CROSS-REFERENCE TO RELATED APPLICATIONS

This application is a continuation of copending U.S. patent application Ser. No. 12/575,430, filed Oct. 7, 2009, which application claims the benefit of U.S. Provisional Application No. 61/109,131, filed Oct. 28, 2008, the contents of all of which are herein expressly incorporated by reference in their entirety.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 968,275 byte ASCII (Text) file named "LS00016 PCT_SeqLstg in Txt" created on Mar. 30, 2011.

BACKGROUND OF THE INVENTION

Petroleum is a limited, natural resource found in the Earth in liquid, gaseous, or solid forms. Petroleum is primarily composed of hydrocarbons, which are comprised mainly of carbon and hydrogen. It also contains significant amounts of other elements, such as, nitrogen, oxygen, or sulfur, in different forms.

Petroleum is a valuable resource, but petroleum products are developed at considerable costs, both financial and environmental. First, sources of petroleum must be discovered. Petroleum exploration is an expensive and risky venture. The cost of exploring deep water wells can exceed $100 million. Moreover, there is no guarantee that these wells will contain petroleum. It is estimated that only 40% of drilled wells lead to productive wells generating commercial hydrocarbons. In addition to the economic cost, petroleum exploration carries a high environmental cost. For example, offshore exploration disturbs the surrounding marine environments.

After a productive well is discovered, the petroleum must be extracted from the Earth at great expense. During primary recovery, the natural pressure underground is sufficient to extract about 20% of the petroleum in the well. As this natural pressure falls, secondary recovery methods are employed, if economical. Generally, secondary recovery involves increasing the well's pressure by, for example, water injection, natural gas injection, or gas lift. Using secondary recovery methods, an additional 5% to 15% of petroleum is recovered. Once secondary recovery methods are exhausted, tertiary recovery methods can be used, if economical. Tertiary methods involve reducing the viscosity of the petroleum to make it easier to extract. Using tertiary recovery methods, an additional 5% to 15% of petroleum is recovered. Hence, even under the best circumstances, only 50% of the petroleum in a well can be extracted. Petroleum extraction also carries an environmental cost. For example, petroleum extraction can result in large seepages of petroleum rising to the surface. Moreover, offshore drilling involves dredging the seabed which disrupts or destroys the surrounding marine environment.

Since petroleum deposits are not found uniformly throughout the Earth, petroleum must be transported over great distances from petroleum producing regions to petroleum consuming regions. In addition to the shipping costs, there is also the environmental risk of devastating oil spills.

In its natural form, crude petroleum extracted from the Earth has few commercial uses. It is a mixture of hydrocarbons (e.g., paraffins (or alkanes), olefins (or alkenes), alkynes, napthenes (or cycloalkanes), aliphatic compounds, aromatic compounds, etc.) of varying length and complexity. In addition, crude petroleum contains other organic compounds (e.g., organic compounds containing nitrogen, oxygen, sulfur, etc.) and impurities (e.g., sulfur, salt, acid, metals, etc.).

Hence, crude petroleum must be refined and purified before it can be used commercially. Due to its high energy density and its easy transportability, most petroleum is refined into fuels, such as transportation fuels (e.g., gasoline, diesel, aviation fuel, etc.), heating oil, liquefied petroleum gas, etc.

Crude petroleum is also a primary source of raw materials for producing petrochemicals. The two main classes of raw materials derived from petroleum are short chain olefins (e.g., ethylene and propylene) and aromatics (e.g., benzene and xylene isomers). These raw materials are derived from longer chain hydrocarbons in crude petroleum by cracking it at considerable expense using a variety of methods, such as catalytic cracking, steam cracking, or catalytic reforming. These raw materials are used to make petrochemicals, which cannot be directly refined from crude petroleum, such as monomers, solvents, detergents, or adhesives.

One example of a raw material derived from crude petroleum is ethylene. Ethylene is used to produce petrochemicals, such as polyethylene, ethanol, ethylene oxide, ethylene glycol, polyester, glycol ether, ethoxylate, vinyl acetate, 1,2-dichloroethane, trichloroethylene, tetrachloroethylene, vinyl chloride, and polyvinyl chloride. An additional example of a raw material is propylene, which is used to produce isopropyl alcohol, acrylonitrile, polypropylene, propylene oxide, propylene glycol, glycol ethers, butylene, isobutylene, 1,3-butadiene, synthetic elastomers, polyolefins, alpha-olefins, fatty alcohols, acrylic acid, acrylic polymers, allyl chloride, epichlorohydrin, and epoxy resins.

These petrochemicals can then be used to make specialty chemicals, such as plastics, resins, fibers, elastomers, pharmaceuticals, lubricants, or gels. Particular specialty chemicals that can be produced from petrochemical raw materials are fatty acids, hydrocarbons (e.g., long chain, branched chain, saturated, unsaturated, etc.), fatty alcohols, esters, fatty aldehydes, ketones, lubricants, etc.

Fatty alcohols have many commercial uses. Worldwide annual sales of fatty alcohols and their derivatives are in excess of US$1 billion. The shorter chain fatty alcohols are used in the cosmetic and food industries as emulsifiers, emollients, and thickeners. Due to their amphiphilic nature, fatty alcohols behave as nonionic surfactants, which are useful in personal care and household products, for example, detergents. In addition, fatty alcohols are used in waxes, gums, resins, pharmaceutical salves and lotions, lubricating oil additives, textile antistatic and finishing agents, plasticizers, cosmetics, industrial solvents, and solvents for fats.

Aldehydes are used to produce many specialty chemicals. For example, aldehydes are used to produce polymers, resins (e.g., Bakelite), dyes, flavorings, plasticizers, perfumes, pharmaceuticals, and other chemicals. Some are used as solvents, preservatives, or disinfectants. Some natural and synthetic compounds, such as vitamins and hormones, are aldehydes. In addition, many sugars contain aldehyde groups.

Obtaining these specialty chemicals from crude petroleum requires a significant financial investment as well as a great deal of energy. It is also an inefficient process because frequently the long chain hydrocarbons in crude petroleum are cracked to produce smaller monomers. These monomers are then used as the raw material to manufacture the more complex specialty chemicals.

In addition to the problems with exploring, extracting, transporting, and refining petroleum, petroleum is a limited and dwindling resource. One estimate of world petroleum consumption is 30 billion barrels per year. By some estimates, it is predicted that at current production levels, the world's petroleum reserves could be depleted before the year 2050.

Finally, the burning of petroleum based fuels releases greenhouse gases (e.g., carbon dioxide) and other forms of air pollution (e.g., carbon monoxide, sulfur dioxide, etc.). As the world's demand for fuel increases, the emission of greenhouse gases and other forms of air pollution also increases. The accumulation of greenhouse gases in the atmosphere can lead to an increase global warming. Hence, in addition to damaging the environment locally (e.g., oil spills, dredging of marine environments, etc.), burning petroleum also damages the environment globally.

Due to the inherent challenges posed by petroleum, there is a need for a renewable petroleum source that does not need to be explored, extracted, transported over long distances, or substantially refined like petroleum. There is also a need for a renewable petroleum source which can be produced economically without creating the type of environmental damage produced by the petroleum industry and the burning of petroleum based fuels. For similar reasons, there is also a need for a renewable source of chemicals which are typically derived from petroleum.

One method of producing renewable petroleum is by engineering microorganisms to produce renewable petroleum products. Some microorganisms have a natural ability to produce chemicals. For example, yeast has been used for centuries to produce ethanol (e.g., beer, wine, etc.). In recent years, through the development of advanced biotechnologies, it is possible to metabolically engineer an organism to produce bioproducts that were never previously produced. Products, such as chemicals, derived from these cellular activities are known as bioproducts. Fuels produced these cellular activities are known as biofuels. Biofuels are a renewable alternative fuel to petroleum based fuels. Biofuels can be substituted for any petroleum based fuel (e.g., gasoline, diesel, aviation fuel, heating oil, etc.). Biofuels can be derived from renewable sources, such as plant matter, animal matter, or even waste products. These renewable sources are collectively known as biomass. One advantage of biofuels over petroleum based fuels is that they do not require expensive and risky exploration or extraction. In addition, biofuels can be locally produced. Hence, they do not require transportation over long distances. Moreover, biofuels can be made directly without the need for expensive and energy intensive refining as is needed with refining crude petroleum. In other circumstances, the biofuel may require a limited and cost-effective level of refining. Furthermore, the use of biofuels improves the environment by reducing the amount of environmentally harmful emissions (e.g., green house gases, air pollution, etc.) released during combustion. For example, biofuels maintain a balanced carbon cycle because biofuels are produced from biomass, a renewable, natural resource. While the burning of biofuels will release carbon (e.g., as carbon dioxide), this carbon will be recycled during the production of biomass (e.g., the cultivation of crops), thereby balancing the carbon cycle unlike petroleum based fuels.

For similar reasons, biologically derived chemicals offer the same advantages as biofuels over petroleum based fuels. Biologically derived chemicals are a renewable alternative to petrochemicals. Biologically derived chemicals, such as hydrocarbons (e.g., alkanes, alkenes, or alkynes), fatty alcohols, esters, fatty acids, fatty aldehydes, and ketones are superior to petrochemicals because they are produced directly without extensive refining. Unlike petrochemicals, biologically derived chemicals do not need to be refined like crude petroleum to recover raw materials which must then be further processed to make more complex petrochemicals. Biologically derived chemicals are directly converted from biomass to the desired chemical product.

SUMMARY OF THE INVENTION

The invention is based, at least in part, on the identification of genes that encode fatty aldehyde biosynthetic polypeptides and fatty alcohol biosynthetic polypeptides, which can be used to produce fatty aldehydes that can subsequently be converted into fatty alcohols. Accordingly, in one aspect, the invention features a method of making a fatty alcohol. The method includes expressing in a host cell a gene encoding a fatty aldehyde biosynthetic polypeptide comprising the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 264, 266, 268, 270, or 272, or a variant thereof. In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the fatty aldehyde biosynthetic polypeptide comprises the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 264, 266, 268, 270, or 272 with one or more amino acid substitutions, additions, insertions, or deletions, and the polypeptide has carboxylic acid reductase activity. In some embodiments, the polypeptide has fatty acid reductase activity.

In some embodiments, the polypeptide comprises one or more of the following conservative amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide has carboxylic acid reductase activity. In some embodiments, the polypeptide has fatty acid reductase activity.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the polypeptide is from a bacterium, a plant, an insect, a yeast, a fungus, or a mammal.

In certain embodiments, the polypeptide is from a mammalian cell, plant cell, insect cell, yeast cell, fungus cell, filamentous fungi cell, bacterial cell, or any other organism described herein. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum,* and *Mycobacterium ulcerans*. In other embodiments, the bacterium is *Nocardia* sp. NRRL 5646, *Nocardia farcinica, Streptomyces griseus, Salinispora arenicola,* or *Clavibacter michiganenesis*.

In some embodiments, the method further includes culturing the host cell in the presence of at least one biological substrate for the fatty aldehyde biosynthetic polypeptide.

In another aspect, the invention features a method of producing a fatty alcohol. The method includes expressing in a host cell a gene encoding a fatty aldehyde biosynthetic polypeptide comprising an amino acid sequence having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 264, 266, 268, 270, or 272. In some embodiments, the amino acid sequence is the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 264, 266, 268, 270, or 272.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16.

In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the polypeptide is from a bacterium, a plant, an insect, a yeast, a fungus, or a mammal.

In certain embodiments, the polypeptide is from a mammalian cell, plant cell, insect cell, yeast cell, fungus cell, filamentous fungi cell, bacterial cell, or any other organism described herein. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum*, and *Mycobacterium ulcerans*. In other embodiments, the bacterium is *Nocardia* sp. NRRL 5646, *Nocardia farcinica, Streptomyces griseus, Salinispora arenicola*, or *Clavibacter michiganenesis*.

In some embodiments, the method further includes culturing the host cell in the presence of at least one biological substrate for the fatty aldehyde biosynthetic polypeptide.

In another aspect, the invention features a method of producing a fatty alcohol. The method includes expressing in a host cell a polynucleotide that hybridizes to a complement of the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 263, 265, 267, 269, or 271, or to a fragment thereof, wherein the polynucleotide encodes a polypeptide having carboxylic acid reductase activity. In some embodiments, the polypeptide has fatty acid reductase activity.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the polynucleotide hybridizes under low stringency, medium stringency, high stringency, or very high stringency conditions, to a complement of the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 263, 265, 267, 269, or 271, or to a fragment thereof.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the polynucleotide is from a bacterium, a plant, an insect, a yeast, a fungus, or a mammal.

In certain embodiments, the polypeptide is from a mammalian cell, plant cell, insect cell, yeast cell, fungus cell, filamentous fungi cell, bacterial cell, or any other organism described herein. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum*, and *Mycobacterium ulcerans*. In other embodiments, the bacterium is *Nocardia* sp. NRRL 5646, *Nocardia farcinica, Streptomyces griseus, Salinispora arenicola*, or *Clavibacter michiganenesis*.

In some embodiments, the method further includes culturing the host cell in the presence of at least one biological substrate for the fatty aldehyde biosynthetic polypeptide.

In another aspect, the invention features a method of producing a fatty alcohol. The method comprises expressing in a host cell a gene encoding a fatty aldehyde biosynthetic polypeptide comprising the amino acid of SEQ ID NO:16, or a variant thereof. In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the polypeptide comprises the amino acid sequence of SEQ ID NO:16 with one or more amino acid substitutions, additions, insertions, or deletions, wherein the polypeptide has carboxylic acid reductase activity. In some embodiments, the polypeptide has fatty acid reductase activity.

In some embodiments, the polypeptide comprises one or more of the following conservative amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide has carboxylic acid reductase activity. In some embodiments, the polypeptide has fatty acid reductase activity.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the method further includes culturing the host cell in the presence of at least one biological substrate for the fatty aldehyde biosynthetic polypeptide.

In another aspect, the invention features a method of producing a fatty alcohol. The method includes expressing in a host cell a gene encoding a fatty aldehyde biosynthetic polypeptide comprising an amino acid sequence having at least about 70% sequence identity to the amino acid sequence of SEQ ID NO:16.

In some embodiments, the method further includes isolating the fatty alcohol from the host cell. In certain embodiments, the fatty alcohol is isolated from the extracellular environment of the host cell. In some embodiments, the fatty alcohol is secreted from the host cell.

In some embodiments, the amino acid sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the amino acid sequence of SEQ ID NO:16. In some embodiments, the amino acid sequence is SEQ ID NO:16.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/ isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the method further includes culturing the host cell in the presence of at least one biological substrate for the fatty aldehyde biosynthetic polypeptide.

In another aspect, the invention features a method of producing a fatty alcohol. The method includes expressing in a host cell a polynucleotide that hybridizes to a complement of the nucleotide sequence of SEQ ID NO:15, or to a fragment thereof, wherein the polynucleotide encodes a polypeptide having carboxylic acid reductase activity. In some embodiments, the polypeptide has fatty acid reductase activity.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the polynucleotide hybridizes under low stringency, medium stringency, high stringency, or very high stringency conditions, to a complement of the nucleotide sequence of SEQ ID NO:15, or to a fragment thereof.

In some embodiments, the method further includes culturing the host cell in the presence of at least one biological substrate for the fatty aldehyde biosynthetic polypeptide.

In another aspect, the invention features a method of producing a fatty alcohol. The method includes expressing in a host cell a recombinant vector comprising a fatty aldehyde biosynthetic nucleotide sequence having at least about 70% sequence identity to a nucleotide sequence listed in FIG. 8. In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 263, 265, 267, 269, or 271. In some embodiments, the nucleotide sequence is SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 263, 265, 267, 269, or 271.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the recombinant vector further comprises a promoter operably linked to the nucleotide sequence. In certain embodiments, the promoter is a developmentally-regulated, an organelle-specific, a tissue-specific, an inducible, a constitutive, or a cell-specific promoter.

In other embodiments, the recombinant vector comprises at least one sequence selected from the group consisting of (a) a regulatory sequence operatively coupled to the nucleotide sequence; (b) a selection marker operatively coupled to the nucleotide sequence; (c) a marker sequence operatively coupled to the nucleotide sequence; (d) a purification moiety operatively coupled to the nucleotide sequence; (e) a secretion sequence operatively coupled to the nucleotide sequence; and (f) a targeting sequence operatively coupled to the nucleotide sequence.

In some embodiments, the recombinant vector is a plasmid.

In some embodiments, the host cell expresses a polypeptide encoded by the recombinant vector. In some embodiments, the nucleotide sequence is stably incorporated into the genomic DNA of the host cell, and the expression of the nucleotide sequence is under the control of a regulated promoter region.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the method further includes culturing the host cell in the presence of at least one biological substrate for a fatty aldehyde biosynthetic polypeptide.

In another aspect, the invention features a method of producing a fatty alcohol. The method includes expressing in a host cell a recombinant vector comprising a fatty aldehyde biosynthetic nucleotide sequence having at least about 70% sequence identity to the nucleotide sequence of SEQ ID NO:15.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:15. In some embodiments, the nucleotide sequence is the nucleotide sequence of SEQ ID NO:15.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the recombinant vector further comprises a promoter operably linked to the nucleotide sequence. In certain embodiments, the promoter is a developmentally-regulated, an organelle-specific, a tissue-specific, an inducible, a constitutive, or a cell-specific promoter.

In other embodiments, the recombinant vector comprises at least one sequence selected from the group consisting of (a) a regulatory sequence operatively coupled to the nucleotide sequence; (b) a selection marker operatively coupled to the nucleotide sequence; (c) a marker sequence operatively coupled to the nucleotide sequence; (d) a purification moiety operatively coupled to the nucleotide sequence; (e) a secretion sequence operatively coupled to the nucleotide sequence; and (f) a targeting sequence operatively coupled to the nucleotide sequence.

In some embodiments, the recombinant vector is a plasmid.

In some embodiments, the host cell expresses a polypeptide encoded by the recombinant vector. In some embodiments, the nucleotide sequence is stably incorporated into the genomic DNA of the host cell, and the expression of the nucleotide sequence is under the control of a regulated promoter region.

In some embodiments, the method further includes culturing the host cell in the presence of at least one biological substrate for a fatty aldehyde biosynthetic polypeptide.

In another aspect, the invention features a method of producing a fatty alcohol. The method includes expressing in a host cell a gene encoding a fatty aldehyde biosynthetic polypeptide comprising (i) SEQ ID NO:7, SEQ ID NO:8, SEQ ID NO:9, and SEQ ID NO:10; (ii) SEQ ID NO:11, SEQ ID NO:12, SEQ ID NO:13, or SEQ ID NO:14; and/or (iii) SEQ ID NO:7, SEQ ID NO:9, SEQ ID NO:10, and SEQ ID NO:11; wherein the polypeptide has carboxylic acid reductase activity. In some embodiments, the polypeptide has fatty acid reductase activity.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the polypeptide is about 1,000 amino acids to about 2,000 amino acids in length. In certain embodiments, the polypeptide is about 1,000 amino acids in length, about 1,050 amino acids in length, about 1,100 amino acids in length, about 1,150 amino acids in length, about 1,200 amino acids in length, about 1,250 amino acids in length, about 1,300 amino acids in length, about 1,400 amino acids in length, about 1,500 amino acids in length, about 1,600 amino acids in length, about 1,700 amino acids in length, about 1,800 amino acids in length, about 1,900 amino acids in length, or about 2,000 amino acids in length. In other embodiments, the polypeptide is up to about 2,000 amino acids in length, up to about 1,900 amino acids in length, up to about 1,800 amino acids in length, up to about 1,700 amino acids in length, up to about 1,600 amino acids in length, up to about 1,500 amino acids in length, up to about 1,400 amino acids in length, up to about 1,300 amino acids in length, up to about 1,250 amino acids in length, up to about 1,200 amino acids in length, up to about 1,150 amino acids in length, up to about 1,100 amino acids in length, up to about 1,050 amino acids in length, or up to about 1,000 amino acids in length. In other embodiments, the polypeptide is more than about 1,000 amino acids in length, more than about 1,050 amino acids in length, more than about 1,100 amino acids in length, more than about 1,150 amino acids in length, more than about 1,200 amino acids in length, more than about 1,250 amino acids in length, more than about 1,300 amino acids in length, more than about 1,400 amino acids in length, more than about 1,500 amino acids in length, more than about 1,600 amino acids in length, more than about 1,700 amino acids in length, more than about 1,800 amino acids in length, more than about 1,900 amino acids in length, or about 2,000 amino acids in length.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty alcohol biosynthetic polypeptide in the host cell. In particular embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the method further includes culturing the host cell in the presence of at least one biological substrate for the fatty aldehyde biosynthetic polypeptide.

In another aspect, the invention features a method of making a fatty alcohol. The method includes expressing in a host cell a gene encoding a fatty alcohol biosynthetic polypeptide comprising the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof. In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194 with one or more amino acid substitutions, additions, insertions, or deletions, and the polypeptide has alcohol dehydrogenase activity.

In some embodiments, the polypeptide comprises one or more of the following conservative amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide has alcohol dehydrogenase activity.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty aldehyde biosynthetic polypeptide in the host cell. In particular embodiments, the fatty aldehyde biosynthetic polypeptide comprises the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 264, 266, 268, 270, or 272, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA. In other embodiments, the host cell is genetically engineered to express an attenuated level of a ketoacyl-ACP synthase, such as an enzyme encoded by fabB. In yet other embodiments, the host cell is genetically engineered to express a modified level of a gene encoding a desaturase enzyme, such as desA.

In some embodiments, the polypeptide is from a bacterium, a plant, an insect, a yeast, a fungus, or a mammal.

In certain embodiments, the polypeptide is from a bacterium. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum*, and *Mycobacterium ulcerans*. In other embodiments, the bacterium is *Nocardia* sp. NRRL 5646, *Nocardia farcinica, Streptomyces griseus, Salinispora arenicola*, or *Clavibacter michiganensis*.

In some embodiments, the method further includes culturing the host cell in the presence of at least one biological substrate for the fatty alcohol biosynthetic polypeptide.

In another aspect, the invention features a method of producing a fatty alcohol. The method includes expressing in a host cell a gene encoding a fatty alcohol biosynthetic polypeptide comprising an amino acid sequence having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194. In some embodiments, the amino acid sequence is SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty aldehyde biosynthetic polypeptide in the host cell. In particular embodiments, the fatty aldehyde biosynthetic polypeptide comprises the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 264, 266, 268, 270, or 272, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074; fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the polypeptide is from a bacterium, a plant, an insect, a yeast, a fungus, or a mammal.

In certain embodiments, the polypeptide is from a mammalian cell, plant cell, insect cell, yeast cell, fungus cell, filamentous fungi cell, bacterial cell, or any other organism described herein. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum,* and *Mycobacterium ulcerans*. In other embodiments, the bacterium is *Nocardia* sp. NRRL 5646, *Nocardia farcinica, Streptomyces griseus, Salinispora arenicola,* or *Clavibacter michiganenesis*.

In some embodiments, the method further includes culturing the host cell in the presence of at least one biological substrate for the fatty alcohol biosynthetic polypeptide.

In another aspect, the invention features a method of producing a fatty alcohol. The method includes expressing in a host cell a polynucleotide that hybridizes to a complement of the nucleotide sequence of SEQ ID NO:93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, or 193, or to a fragment thereof, wherein the polynucleotide encodes a polypeptide having alcohol dehydrogenase activity.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the polynucleotide hybridizes under low stringency, medium stringency, high stringency, or very high stringency conditions, to a complement of the nucleotide sequence of SEQ ID NO:93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, or 193, or to a fragment thereof.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty aldehyde biosynthetic polypeptide in the host cell. In particular embodiments, the fatty aldehyde biosynthetic polypeptide comprises the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 264, 266, 268, 270, or 272, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the polynucleotide is from a bacterium, a plant, an insect, a yeast, a fungus, or a mammal.

In certain embodiments, the polypeptide is from a mammalian cell, plant cell, insect cell, yeast cell, fungus cell, filamentous fungi cell, bacterial cell, or any other organism described herein. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum,* and *Mycobacterium ulcerans*. In other embodiments, the bacterium is *Nocardia* sp. NRRL 5646, *Nocardia farcinica, Streptomyces griseus, Salinispora arenicola,* or *Clavibacter michiganenesis*.

In some embodiments, the method further includes culturing the host cell in the presence of at least one biological substrate for the fatty aldehyde biosynthetic polypeptide.

In another aspect, the invention features a method of producing a fatty alcohol. The method includes expressing in a host cell a recombinant vector comprising a fatty alcohol biosynthetic nucleotide sequence having at least about 70% sequence identity to the nucleotide sequence of SEQ ID NO:93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, or 193. In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, or 193. In some embodiments, the nucleotide sequence is of SEQ ID NO:93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, or 193.

In some embodiments, the method further includes isolating the fatty alcohol from the host cell. In some embodiments, the fatty alcohol is present in the extracellular environment. In certain embodiments, the fatty alcohol is isolated from the extracellular environment of the host cell. In some embodiments, the fatty alcohol is secreted from the host cell. In alternative embodiments, the fatty alcohol is transported into the extracellular environment. In other embodiments, the fatty alcohol is passively transported into the extracellular environment.

In some embodiments, the recombinant vector further comprises a promoter operably linked to the nucleotide sequence. In certain embodiments, the promoter is a developmentally-regulated, an organelle-specific, a tissue-specific, an inducible, a constitutive, or a cell-specific promoter.

In other embodiments, the recombinant vector comprises at least one sequence selected from the group consisting of (a) a regulatory sequence operatively coupled to the nucleotide sequence; (b) a selection marker operatively coupled to the nucleotide sequence; (c) a marker sequence operatively coupled to the nucleotide sequence; (d) a purification moiety operatively coupled to the nucleotide sequence; (e) a secretion sequence operatively coupled to the nucleotide sequence; and (f) a targeting sequence operatively coupled to the nucleotide sequence.

In some embodiments, the recombinant vector is a plasmid.

In some embodiments, the host cell expresses a polypeptide encoded by the recombinant vector. In some embodiments, the nucleotide sequence is stably incorporated into the genomic DNA of the host cell, and the expression of the nucleotide sequence is under the control of a regulated promoter region.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes expressing a gene encoding a fatty aldehyde biosynthetic polypeptide in the host cell. In particular embodiments, the fatty aldehyde biosynthetic polypeptide comprises the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 264, 266, 268, 270, or 272, or a variant thereof.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 15. In some embodiments, the host cell comprises a knockout of fabA or a gene listed in FIG. 15. In other embodiments, the host cell is genetically engineered to express an attenuated level of a ketoacyl-ACP synthase, such as an enzyme encoded by fabB or by a gene listed in FIG. 16. In certain embodiments, the host cell comprises a knockout of fabB or a gene listed in FIG. 16. In yet other embodiments, the host cell is genetically engineered to express a modified level of a gene encoding a desaturase enzyme, such as desA.

In some embodiments, the method further includes culturing the host cell in the presence of at least one biological substrate for a fatty alcohol biosynthetic polypeptide.

In any of the aspects of the invention described herein, the host cell can be selected from the group consisting of a mammalian cell, plant cell, insect cell, yeast cell, fungus cell, filamentous fungi cell, and bacterial cell.

In some embodiments, the host cell is a Gram-positive bacterial cell. In other embodiments, the host cell is a Gram-negative bacterial cell.

In some embodiments, the host cell is selected from the genus *Escherichia, Bacillus, Lactobacillus, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia,* or *Streptomyces*.

In certain embodiments, the host cell is a *Bacillus lentus* cell, a *Bacillus brevis* cell, a *Bacillus stearothermophilus* cell, a *Bacillus licheniformis* cell, a *Bacillus alkalophilus* cell, a *Bacillus coagulans* cell, a *Bacillus circulans* cell, a *Bacillus pumilis* cell, a *Bacillus thuringiensis* cell, a *Bacillus clausii* cell, a *Bacillus inegaterium* cell, a *Bacillus subtilis* cell, or a *Bacillus amyloliquefaciens* cell.

In other embodiments, the host cell is a *Trichoderma koningii* cell, a *Trichoderma viride* cell, a *Trichoderma reesei* cell, a *Trichoderma longibrachiatum* cell, an *Aspergillus awamori* cell, an *Aspergillus fumigates* cell, an *Aspergillus foetidus* cell, an *Aspergillus nidulans* cell, an *Aspergillus niger* cell, an *Aspergillus oryzae* cell, a *Humicola insolens* cell, a *Humicola lanuginose* cell, a *Rhodococcus opacus* cell, a *Rhizomucor miehei* cell, or a *Mucor michei* cell.

In yet other embodiments, the host cell is a *Streptomyces lividans* cell or a *Streptomyces murinus* cell.

In yet other embodiments, the host cell is an *Actinomycetes* cell.

In some embodiments, the host cell is a *Saccharomyces cerevisiae* cell. In some embodiments, the host cell is a *Saccharomyces cerevisiae* cell.

In particular embodiments, the host cell is a cell from an eukaryotic plant, algae, cyanolacterium, green-sulfur bacterium, green non-sulfur bacterium, purple sulfur bacterium, purple non-sulfur bacterium, extremophile, yeast, fungus, engineered organisms thereof, or a synthetic organism. In some embodiments, the host cell is light dependent or fixes carbon. In some embodiments, the host cell is light dependent or fixes carbon. In some embodiments, the host cell has autotrophic activity. In some embodiments, the host cell has photoautotrophic activity, such as in the presence of light. In some embodiments, the host cell is heterotrophic or mixotrophic in the absence of light. In certain embodiments, the host cell is a cell from *Avabidopsis thaliana, Panicum virgatum, Miscanthus giganteus, Zea mays, Botryococcuse braunii, Chlamydomonas reinhardtii, Dunaliela salina, Synechococcus* Sp. PCC 7002, *Synechococcus* Sp. PCC 7942, *Synechocystis* Sp. PCC 6803, *Thermosynechococcus elongates* BP-1, *Chlorobium tepidum, Chloroflexus auranticus, Chromatiumm vinosum, Rhodospirillum rubrum, Rhodobacter capsulatus, Rhodopseudomonas palusris, Clostridium ljungdahlii, Clostridiuthermocellum, Penicillium chrysogenum, Pichia pastoris, Saccharomyces cerevisiae, Schizosaccharomyces pombe, Pseudomonas fluorescens,* or *Zymomonas mobilis*.

In other embodiments, the host cell is a CHO cell, a COS cell, a VERO cell, a BHK cell, a HeLa cell, a Cv1 cell, an MDCK cell, a 293 cell, a 3T3 cell, or a PC12 cell.

In yet other embodiments, the host cell is an *E. coli* cell. In certain embodiments, the *E. coli* cell is a strain B, a strain C, a strain K, or a strain W *E. coli* cell.

In another aspect, the invention features a method of producing a fatty alcohol. The method includes contacting a substrate with (i) a fatty alcohol biosynthetic polypeptide comprising the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194, or a variant thereof, or (ii) a fatty alcohol biosynthetic polypeptide encoded by a nucleotide sequence having at least about 70% identity to the nucleotide sequence of SEQ ID NO:93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, or 193, or a variant thereof. In some embodiments, the method further includes purifying the fatty alcohol.

In some embodiments, the fatty alcohol biosynthetic polypeptide comprises the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194 with one or more amino acid substitutions, additions, insertions, or deletions, wherein the polypeptide has alcohol dehydrogenase activity.

In some embodiments, the polypeptide comprises one or more of the following conservative amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide has alcohol dehydrogenase activity.

In some embodiments, the polypeptide has an amino acid sequence that is at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194. In some embodiments, the polypeptide has the amino acid sequence of SEQ ID NO:94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, or 194.

In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, or 193. In some embodiments, the nucleotide sequence is SEQ ID NO:93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, or 193.

In any of the aspects of the invention described herein, the methods can produce fatty alcohols comprising a $C_6$-$C_{26}$ fatty alcohol. In some embodiments, the fatty alcohol comprises a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{21}$, $C_{22}$, $C_{23}$, $C_{24}$, $C_{25}$, or a $C_{26}$ fatty alcohol. In particular embodiments, the fatty alcohol is a $C_6$, $C_8$, $C_{10}$, $C_{12}$, $C_{13}$, $C_{14}$, $C_{15}$, $C_{16}$, $C_{17}$, or $C_{18}$ fatty alcohol. In certain embodiments, the hydroxyl group of the fatty alcohol is in the primary ($C_1$) position.

In other embodiments, the fatty alcohol comprises a straight chain fatty alcohol. In other embodiments, the fatty alcohol comprises a branched chain fatty alcohol. In yet other embodiments, the fatty alcohol comprises a cyclic moiety.

In some embodiments, the fatty alcohol is an unsaturated fatty alcohol. In other embodiments, the fatty alcohol is a monounsaturated fatty alcohol. In certain embodiments, the unsaturated fatty alcohol is a C6:1, C7:1, C8:1, C9:1, C10:1, C11:1, C12:1, C13:1, C14:1, C15:1, C16:1, C17:1, C18:1, C19:1, C20:1, C21:1, C22:1, C23:1, C24:1, C25:1, or a C26:1 unsaturated fatty alcohol. In yet other embodiments, the fatty alcohol is unsaturated at the omega-7 position. In certain embodiments, the unsaturated fatty alcohol comprises a cis double bond.

In yet other embodiments, the fatty alcohol is a saturated fatty alcohol.

In any of the aspects of the invention described herein, a substrate for a fatty aldehyde biosynthetic polypeptide can be a fatty acid. In some embodiments, the fatty acid comprises a $C_6$-$C_{26}$ fatty acid. In some embodiments, the fatty acid comprises a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{21}$, $C_{22}$, $C_{23}$, $C_{24}$, $C_{25}$, or a $C_{26}$ fatty acid. In particular embodiments, the fatty acid is a $C_6$, $C_8$, $C_{10}$, $C_{12}$, $C_{13}$, $C_{14}$, $C_{15}$, $C_{16}$, $C_{17}$, or $C_{18}$ fatty acid.

In other embodiments, the fatty acid comprises a straight chain fatty acid. In other embodiments, the fatty acid comprises a branched chain fatty acid. In yet other embodiments, the fatty acid comprises a cyclic moiety.

In some embodiments, the fatty acid is an unsaturated fatty acid. In other embodiments, the fatty acid is a monounsaturated fatty acid. In yet other embodiments, the fatty acid is a saturated fatty acid.

In another aspect, the invention features a genetically engineered microorganism comprising an exogenous control sequence stably incorporated into the genomic DNA of the microorganism upstream of a polynucleotide comprising a nucleotide sequence having at least about 70% sequence identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 263, 265, 267, 269, or 271, wherein the microorganism produces an increased level of a fatty alcohol relative to a wild-type microorganism.

In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 263, 265, 267, 269, or 271. In some embodiments, the nucleotide sequence is SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 263, 265, 267, 269, or 271.

In some embodiments, the polynucleotide is endogenous to the microorganism.

In other embodiments, the microorganism is genetically engineered to express a modified level of a gene encoding a fatty acid synthase in the host cell. In certain embodiments, the microorganism expresses a recombinant gene encoding a fatty acid synthase or expresses an increased level of an endogenous fatty acid synthase. In alternate embodiments, the microorganism expresses an attenuated level of a gene encoding a fatty acid synthase in the host cell and/or a decreased expression or activity of an endogenous fatty acid synthase. In some embodiments, the fatty acid synthase is a thioesterase. In particular embodiments, the thioesterase is encoded by tesA, tesA without leader sequence, tesB, fatB, fatB2, fatB3, fatA, or fatA1.

In other embodiments, the microorganism is genetically engineered to express an attenuated level of a fatty acid degradation enzyme relative to a wild type microorganism. In some embodiments, the microorganism expresses an attenuated level of an acyl-CoA synthase relative to a wild type microorganism. In particular embodiments, the microorganism expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the microorganism comprises a knockout of one or more genes encoding a fatty acid degradation enzyme, such as the aforementioned acyl-CoA synthase genes.

In yet other embodiments, the microorganism is genetically engineered to express an attenuated level of a dehydratase/isomerase enzyme, such as an enzyme encoded by fabA or by a gene listed in FIG. 15. In some embodiments, the microorganism comprises a knockout of fabA or a gene listed in FIG. 15. In other embodiments, the microorganism is genetically engineered to express an attenuated level of a ketoacyl-ACP synthase, such as an enzyme encoded by fabB or by a gene listed in FIG. 16. In certain embodiments, the microorganism comprises a knockout of fabB or a gene listed in FIG. 16. In yet other embodiments, the microorganism is genetically engineered to express a modified level of a gene encoding a desaturase enzyme, such as desA.

In some embodiments, the microorganism is a bacterium. In certain embodiments, the bacterium is a Gram-negative or a Gram-positive bacterium.

In some embodiments, the microorganism is a mycobacterium selected from the group consisting of *Mycobacterium smegmatis*, *Mycobacterium abscessus*, *Mycobacterium avium*, *Mycobacterium bovis*, *Mycobacterium tuberculosis*, *Mycobacterium leprae*, *Mycobacterium marinum*, and *Mycobacterium ulcerans*.

In other embodiments, the microorganism is *Nocardia* sp. NRRL 5646, *Nocardia farcinica*, *Streptomyces griseus*, *Salinispora arenicola*, or *Clavibacter michiganenesis*.

In another aspect, the invention features a fatty alcohol produced by any of the methods or any of the microorganisms described herein, or a surfactant comprising a fatty alcohol produced by any of the methods or any of the microorganisms described herein.

In some embodiments, the fatty alcohol has a $\delta^{13}C$ of about −15.4 or greater. In certain embodiments, the fatty alcohol has a $\delta^{13}C$ of about −15.4 to about −10.9, or of about −13.92 to about −13.84.

In some embodiments, the fatty alcohol has an $f_M{}^{14}C$ of at least about 1.003. In certain embodiments, the fatty alcohol has an $f_M{}^{14}C$ of at least about 1.01 or at least about 1.5. In some embodiments, the fatty alcohol has an $f_M{}^{14}C$ of about 1.111 to about 1.124.

In any of the aspects described herein, a fatty alcohol is produced at a yield of about 25 mg/L, about 50 mg/L, about 75 mg/L, about 100 mg/L, about 125 mg/L, about 150 mg/L, about 175 mg/L, about 200 mg/L, about 225 mg/L, about 250 mg/L, about 275 mg/L, about 300 mg/L, about 325 mg/L, about 350 mg/L, about 375 mg/L, about 400 mg/L, about 425 mg/L, about 450 mg/L, about 475 mg/L, about 500 mg/L, about 525 mg/L, about 550 mg/L, about 575 mg/L, about 600 mg/L, about 625 mg/L, about 650 mg/L, about 675 mg/L, about 700 mg/L, about 725 mg/L, about 750 mg/L, about 775 mg/L, about 800 mg/L, about 825 mg/L, about 850 mg/L, about 875 mg/L, about 900 mg/L, about 925 mg/L, about 950 mg/L, about 975 mg/L, about 1000 g/L, about 1050 mg/L, about 1075 mg/L, about 1100 mg/L, about 1125 mg/L, about 1150 mg/L, about 1175 mg/L, about 1200 mg/L, about 1225 mg/L, about 1250 mg/L, about 1275 mg/L, about 1300 mg/L, about 1325 mg/L, about 1350 mg/L, about 1375 mg/L, about 1400 mg/L, about 1425 mg/L, about 1450 mg/L, about 1475 mg/L, about 1500 mg/L, about 1525 mg/L, about 1550 mg/L, about 1575 mg/L, about 1600 mg/L, about 1625 mg/L, about 1650 mg/L, about 1675 mg/L, about 1700 mg/L, about 1725 mg/L, about 1750 mg/L, about 1775 mg/L, about 1800 mg/L, about 1825 mg/L, about 1850 mg/L, about 1875 mg/L, about 1900 mg/L, about 1925 mg/L, about 1950 mg/L, about 1975 mg/L, about 2000 mg/L, or more.

In another aspect, the invention features a method of making a fatty alcohol described herein. The method includes culturing a host cell described herein in a medium having a low level of iron, under conditions sufficient to produce a fatty alcohol, as described herein. In particular embodiments, the medium contains less than about 500 μM iron, less than about 400 μM iron, less than about 300 μM iron, less than about 200 μM iron, less than about 150 μM iron, less than about 100 μM iron, less than about 90 μM iron, less than about 80 μM iron, less than about 70 μM iron, less than about 60 μM iron, less than about 50 μM iron, less than about 40 μM iron, less than about 30 μM iron, less than about 20 μM iron, less than about 10 μM iron, or less than about 5 μM iron. In certain embodiments, the medium does not contain iron.

In any of the aspects described herein, a fatty alcohol is produced in a host cell or a microorganism described herein from a carbon source.

The following figures are presented for the purpose of illustration only, and are not intended to be limiting.

BRIEF DESCRIPTION OF THE DRAWINGS

FIG. 6A-FIG. 6B is a listing of the nucleotide sequence and the corresponding amino acid sequence of *Nocardia* sp. NRRL 5646 car gene.

FIG. 7A-FIG. 7B is a listing of amino acid sequence motifs for CAR homologs.

FIG. 8A-FIG. 8UUU is a listing of nucleotide and amino acid sequences of car homolog genes.

FIG. 9 is a table identifying exemplary genes that can be expressed, overexpressed, or attenuated to increase production of particular substrates.

FIG. 10 is a listing of nucleotide and amino acid sequences of alcohol dehydrogenase genes.

FIG. 14A is a graphic representation of fatty alcohol production in various Hu9 culture media. FIG. 14B is a graphic representation of fatty alcohol production in various Hu9 culture media.

FIG. 15 is a listing of nucleotide and amino acid sequences of fabA related genes.

FIG. 16 is a listing of nucleotide and amino acid sequences of fabB related genes.

FIG. 17 is a listing of additional nucleotide and amino acid sequences of the disclosure.

DETAILED DESCRIPTION OF THE INVENTION

Figure 1:
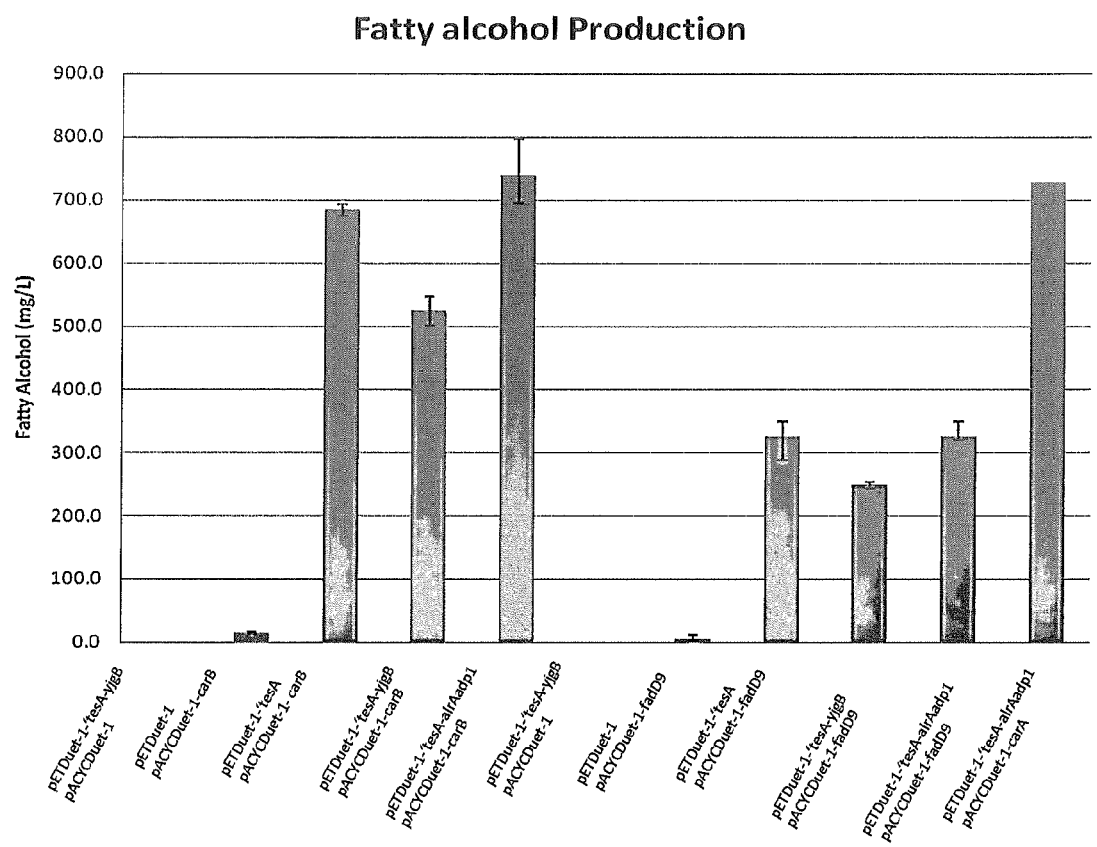
FIG. 1 is a graphic representation of fatty alcohols produced by recombinant *E. coli* strains transformed with various plasmids.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein, including GenBank database sequences, are incorporated by reference in their entirety. In case of conflict, the present specification, including definitions, will control. In addition, the materials, methods, and examples are illustrative only and not intended to be limiting.

Other features and advantages of the invention will be apparent from the following detailed description, and from the claims.

Definitions

Throughout the specification, a reference may be made using an abbreviated gene name or polypeptide name, but it is understood that such an abbreviated gene or polypeptide name represents the genus of genes or polypeptides. Such gene names include all genes encoding the same polypeptide and homologous polypeptides having the same physiological function. Polypeptide names include all polypeptides that have the same activity (e.g., that catalyze the same fundamental chemical reaction).

Unless otherwise indicated, the accession numbers referenced herein are derived from the NCBI database (National Center for Biotechnology Information) maintained by the National Institute of Health, U.S.A. Unless otherwise indicated, the accession numbers are as provided in the database as of October 2008.

EC numbers are established by the Nomenclature Committee of the International Union of Biochemistry and Molecular Biology (NC-IUBMB) (available at on the world-wide web at www.chem.qmul.ac.uk/iubmb/enzyme/. The EC numbers referenced herein are derived from the KEGG Ligand database, maintained by the Kyoto Encyclopedia of Genes and Genomics, sponsored in part by the University of Tokyo. Unless otherwise indicated, the EC numbers are as provided in the database as of October 2008.

The articles "a" and "an" are used herein to refer to one or to more than one (i.e., to at least one) of the grammatical object of the article. By way of example, "an element" means one element or more than one element.

The term "about" is used herein to mean a value ±20% of a given numerical value. Thus, "about 60%" means a value of between 60±(20% of 60) (i.e., between 48 and 70).

As used herein, the term "alcohol dehydrogenase" (EC 1.1.1.*) is a peptide capable of catalyzing the conversion of a fatty aldehyde to an alcohol (e.g., fatty alcohol). Additionally, one of ordinary skill in the art will appreciate that some alcohol dehydrogenases will catalyze other reactions as well. For example, some alcohol dehydrogenases will accept other substrates in addition to fatty aldehydes. Such non-specific alcohol dehydrogenases are, therefore, also included in this definition. Nucleic acid sequences encoding alcohol dehydrogenases are known in the art, and such alcohol dehydrogenases are publicly available. Exemplary GenBank Accession Numbers are provided in FIG. 9.

As used herein, the term "attenuate" means to weaken, reduce or diminish. For example, a polypeptide can be attenuated by modifying the polypeptide to reduce its activity (e.g., by modifying a nucleotide sequence that encodes the polypeptide).

As used herein, the term "biodiesel" means a biofuel that can be a substitute of diesel, which is derived from petroleum. Biodiesel can be used in internal combustion diesel engines in either a pure form, which is referred to as "neat" biodiesel, or as a mixture in any concentration with petroleum-based diesel. Biodiesel can include esters or hydrocarbons, such as alcohols.

As used therein, the term "biofuel" refers to any fuel derived from biomass. Biofuels can be substituted for petroleum based fuels. For example, biofuels are inclusive of transportation fuels (e.g., gasoline, diesel, jet fuel, etc.), heating fuels, and electricity-generating fuels. Biofuels are a renewable energy source.

As used herein, the term "biomass" refers to any biological material from which a carbon source is derived. In some instances, a biomass is processed into a carbon source, which is suitable for bioconversion. In other instances, the biomass may not require further processing into a carbon source. The carbon source can be converted into a biofuel. One exemplary source of biomass is plant matter or vegetation. For example, corn, sugar cane, or switchgrass can be used as biomass. Another non-limiting example of biomass is metabolic wastes, such as animal matter, for example cow manure. In addition, biomass may include algae and other marine plants. Biomass also includes waste products from industry, agriculture, forestry, and households. Examples of such waste products that can be used as biomass are fermentation waste, ensilage, straw, lumber, sewage, garbage, cellulosic urban waste, and food leftovers. Biomass also includes sources of carbon, such as carbohydrates (e.g., monosaccharides, disaccharides, or polysaccharides).

As used herein, the phrase "carbon source" refers to a substrate or compound suitable to be used as a source of carbon for prokaryotic or simple eukaryotic cell growth. Carbon sources can be in various forms, including, but not limited to polymers, carbohydrates, acids, alcohols, aldehydes, ketones, amino acids, peptides, and gases (e.g., CO and $CO_2$). These include, for example, various monosaccharides, such as glucose, fructose, mannose, and galactose; oligosaccharides, such as fructo-oligosaccharide and galacto-oligosaccharide; polysaccharides such as xylose and arabinose; disaccharides, such as sucrose, maltose, and turanose; cellulosic material, such as methyl cellulose and sodium carboxymethyl cellulose; saturated or unsaturated fatty acid esters, such as succinate, lactate, and acetate; alcohols, such as ethanol, methanol, and glycerol, or mixtures thereof. The carbon source can also be a product of photosynthesis, including, but not limited to, glucose. A preferred carbon source is biomass. Another preferred carbon source is glucose.

A nucleotide sequence is "complementary" to another nucleotide sequence if each of the bases of the two sequences matches (i.e., is capable of forming Watson Crick base pairs). The term "complementary strand" is used herein interchangeably with the term "complement". The complement of a nucleic acid strand can be the complement of a coding strand or the complement of a non-coding strand.

As used herein, a "cloud point lowering additive" is an additive added to a composition to decrease or lower the cloud point of a solution.

As used herein, the phrase "cloud point of a fluid" means the temperature at which dissolved solids are no longer completely soluble. Below this temperature, solids begin precipitating as a second phase giving the fluid a cloudy appearance. In the petroleum industry, cloud point refers to the temperature below which a solidified material or other heavy hydrocarbon crystallizes in a crude oil, refined oil, or fuel to form a cloudy appearance. The presence of solidified materials influences the flowing behavior of the fluid, the tendency of the fluid to clog fuel filters, injectors, etc., the accumulation of solidified materials on cold surfaces (e.g., a pipeline or heat exchanger fouling), and the emulsion characteristics of the fluid with water.

As used herein, the term "conditions sufficient to allow expression" means any conditions that allow a host cell to produce a desired product, such as a polypeptide or fatty aldehyde described herein. Suitable conditions include, for example, fermentation conditions. Fermentation conditions can comprise many parameters, such as temperature ranges, levels of aeration, and media composition. Each of these conditions, individually and in combination, allows the host cell to grow. Exemplary culture media include broths or gels. Generally, the medium includes a carbon source, such as glucose, fructose, cellulose, or the like, that can be metabolized by a host cell directly. In addition, enzymes can be used in the medium to facilitate the mobilization (e.g., the depolymerization of starch or cellulose to fermentable sugars) and subsequent metabolism of the carbon source.

To determine if conditions are sufficient to allow expression, a host cell can be cultured, for example, for about 4, 8, 12, 24, 36, or 48 hours. During and/or after culturing, samples can be obtained and analyzed to determine if the conditions allow expression. For example, the host cells in the sample or the medium in which the host cells were grown can be tested for the presence of a desired product. When testing for the presence of a product, assays, such as, but not limited to, Thin Layer Chromatography (TLC), High-Performance Liquid Chromatography (HPLC), GC with Flame Ionization Detector (GC/FID), Gas chromatography—mass spectrometry (GC/MS), Liquid chromatography—mass spectrometry (LC/MS), mass spectrometry (MS), can be used.

It is understood that the polypeptides described herein may have additional conservative or non-essential amino acid substitutions, which do not have a substantial effect on the polypeptide functions. Whether or not a particular substitution will be tolerated (i.e., will not adversely affect desired biological properties, such as carboxylic acid reductase activity) can be determined as described in Bowie et al. *Science* (1990) 247:1306 1310. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), and aromatic side chains (e.g., tyrosine, phenylalanine, tryptophan, histidine).

As used herein, "control element" means a transcriptional control element. Control elements include promoters and enhancers. The term "promoter element," "promoter," or "promoter sequence" refers to a DNA sequence that functions as a switch that activates the expression of a gene. If the gene is activated, it is said to be transcribed or participating in transcription. Transcription involves the synthesis of mRNA from the gene. A promoter, therefore, serves as a transcriptional regulatory element and also provides a site for initiation of transcription of the gene into mRNA. Control elements interact specifically with cellular proteins involved in transcription (Maniatis et al., *Science* 236:1237, 1987).

As used herein, the term "fatty acid" means a carboxylic acid having the formula RCOOH. R represents an aliphatic group, preferably an alkyl group. R can comprise between about 4 and about 22 carbon atoms. Fatty acids can be saturated, monounsaturated, or polyunsaturated. In a preferred embodiment, the fatty acid is made from a fatty acid biosynthetic pathway.

As used herein, the term "fatty acid biosynthetic pathway" means a biosynthetic pathway that produces fatty acids. The fatty acid biosynthetic pathway includes fatty acid synthases that can be engineered, as described herein, to produce fatty acids, and in some embodiments can be expressed with additional enzymes to produce fatty acids having desired carbon chain characteristics.

As used herein, the term "fatty acid degradation enzyme" means an enzyme involved in the breakdown or conversion of a fatty acid or fatty acid derivative into another product. A nonlimiting example of a fatty acid degradation enzyme is an acyl-CoA synthase. Additional examples of fatty acid degradation enzymes are described herein.

As used herein, the term "fatty acid derivative" means products made in part from the fatty acid biosynthetic pathway of the production host organism. "Fatty acid derivative" also includes products made in part from acyl-ACP or acyl-ACP derivatives. The fatty acid biosynthetic pathway includes fatty acid synthase enzymes which can be engineered as described herein to produce fatty acid derivatives, and in some examples can be expressed with additional enzymes to produce fatty acid derivatives having desired carbon chain characteristics. Exemplary fatty acid derivatives include for example, fatty acids, acyl-CoA, fatty aldehyde, short and long chain alcohols, hydrocarbons, fatty alcohols, and esters (e.g., waxes, fatty acid esters, or fatty esters).

As used herein, the term "fatty acid derivative enzyme" means any enzyme that may be expressed or overexpressed in the production of fatty acid derivatives. These enzymes may be part of the fatty acid biosynthetic pathway. Non-limiting examples of fatty acid derivative enzymes include fatty acid synthases, thioesterases, acyl-CoA synthases, acyl-CoA reductases, alcohol dehydrogenases, alcohol acyltransferases, fatty alcohol-forming acyl-CoA reductases, fatty acid (carboxylic acid) reductases, acyl-ACP reductases, fatty acid hydroxylases, acyl-CoA desaturases, acyl-ACP desaturases, acyl-CoA oxidases, acyl-CoA dehydrogenases, ester synthases, and alkane biosynthetic polypeptides, etc. Fatty acid derivative enzymes can convert a substrate into a fatty acid derivative. In some examples, the substrate may be a fatty acid derivative that the fatty acid derivative enzyme converts into a different fatty acid derivative.

As used herein, "fatty acid enzyme" means any enzyme involved in fatty acid biosynthesis. Fatty acid enzymes can be modified in host cells to produce fatty acids. Non-limiting examples of fatty acid enzymes include fatty acid synthases and thioesterases. Additional examples of fatty acid enzymes are described herein.

As used herein, "fatty acid synthase" means any enzyme involved in fatty acid biosynthesis. Fatty acid synthases can be expressed or overexpressed in host cells to produce fatty acids. A non-limiting example of a fatty acid synthase is a thioesterase. Additional examples of fatty acid synthases are described herein.

As used herein, "fatty aldehyde" means an aldehyde having the formula RCHO characterized by an unsaturated carbonyl group (C=O). In a preferred embodiment, the fatty aldehyde is any aldehyde made from a fatty acid or fatty acid derivative. In one embodiment, the R group is at least about 1, 2, 3, 4, 5, 6, 7, 8, 9, 10, 11, 12, 13, 14, 15, 16, 17, 18, 19, or 20 carbons in length.

R can be straight or branched chain. The branched chains may have one or more points of branching. In addition, the branched chains may include cyclic branches.

Furthermore, R can be saturated or unsaturated. If unsaturated, the R can have one or more points of unsaturation.

In one embodiment, the fatty aldehyde is produced biosynthetically.

Fatty aldehydes have many uses. For example, fatty aldehydes can be used to produce many specialty chemicals. For example, fatty aldehydes are used to produce polymers, resins, dyes, flavorings, plasticizers, perfumes, pharmaceuticals, and other chemicals. Some are used as solvents, preservatives, or disinfectants. Some natural and synthetic compounds, such as vitamins and hormones, are aldehydes.

The terms "fatty aldehyde biosynthetic polypeptide", "carboxylic acid reductase", and "CAR" are used interchangeably herein.

As used herein, "fatty alcohol" means an alcohol having the formula ROH. In a preferred embodiment, the fatty alcohol is any alcohol made from a fatty acid or fatty acid derivative. In one embodiment, the R group is at least about 5, 6, 7, 8, 9, 10, 11, 12, 13, 14, 15, 16, 17, 18, 19, or 20 carbons in length.

R can be straight or branched chain. The branched chains may have one or more points of branching. In addition, the branched chains may include cyclic branches.

Furthermore, R can be saturated or unsaturated. If unsaturated, the R can have one or more points of unsaturation.

In one embodiment, the fatty alcohol is produced biosynthetically.

Fatty alcohols have many uses. For example, fatty alcohols can be used to produce many specialty chemicals. For example, fatty alcohols are used as a biofuel; as solvents for fats, waxes, gums, and resins; in pharmaceutical salves, emolients and lotions; as lubricating-oil additives; in detergents and emulsifiers; as textile antistatic and finishing agents; as plasticizers; as nonionic surfactants; and in cosmetics, for examples as thickeners.

As used herein, "fraction of modern carbon" or "$f_M$" has the same meaning as defined by National Institute of Standards and Technology (NIST) Standard Reference Materials (SRMs) 4990B and 4990C, known as oxalic acids standards HOxI and HOxII, respectively. The fundamental definition relates to 0.95 times the $^{14}C/^{12}C$ isotope ratio HOxI (referenced to AD 1950). This is roughly equivalent to decay-corrected pre-Industrial Revolution wood. For the current living biosphere (plant material), $f_M$ is approximately 1.1.

"Gene knockout", as used herein, refers to a procedure by which a gene encoding a target protein is modified or inactivated so to reduce or eliminate the function of the intact protein. Inactivation of the gene may be performed by general methods such as mutagenesis by UV irradiation or treatment with N-methyl-N'-nitro-N-nitrosoguanidine, site-directed mutagenesis, homologous recombination, insertion-deletion mutagenesis, or "Red-driven integration" (Datsenko et al., Proc. Natl. Acad. Sci. USA, 97:6640-45, 2000). For example, in one embodiment, a construct is introduced into a host cell, such that it is possible to select for homologous recombination events in the host cell. One of skill in the art can readily design a knock-out construct including both positive and negative selection genes for efficiently selecting transfected cells that undergo a homologous recombination event with the construct. The alteration in the host cell may be obtained, for example, by replacing through a single or double crossover recombination a wild type DNA sequence by a DNA sequence containing the alteration. For convenient selection of transformants, the alteration may, for example, be a DNA sequence encoding an antibiotic resistance marker or a gene complementing a possible auxotrophy of the host cell. Mutations include, but are not limited to, deletion-insertion mutations. An example of such an alteration includes a gene disruption, i.e., a perturbation of a gene such that the product that is normally produced from this gene is not produced in a functional form. This could be due to a complete deletion, a deletion and insertion of a selective marker, an insertion of a selective marker, a frameshift mutation, an in-frame deletion, or a point mutation that leads to premature termination. In some instances, the entire mRNA for the gene is absent. In other situations, the amount of mRNA produced varies.

Calculations of "homology" between two sequences can be performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence that is aligned for comparison purposes is at least about 30%, preferably at least about 40%, more preferably at least about 50%, even more preferably at least about 60%, and even more preferably at least about 70%, at least about 80%, at least about 90%, or about 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps and the length of each gap, which need to be introduced for optimal alignment of the two sequences.

The comparison of sequences and determination of percent homology between two sequences can be accomplished using a mathematical algorithm. In a preferred embodiment, the percent homology between two amino acid sequences is determined using the Needleman and Wunsch (1970), J. Mol. Biol. 48:444 453, algorithm that has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent homology between two nucleotide sequences is determined using the GAP program in the GCG software package, using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about which parameters should be applied to determine if a molecule is within a homology limitation of the claims) are a Blossum 62 scoring matrix with a gap penalty of 12, a gap extend penalty of 4, and a frameshift gap penalty of 5.

As used herein, a "host cell" is a cell used to produce a product described herein (e.g., a fatty alcohol described herein). A host cell can be modified to express or overexpress selected genes or to have attenuated expression of selected genes. Non-limiting examples of host cells include plant, animal, human, bacteria, yeast, or filamentous fungi cells.

As used herein, the term "hybridizes under low stringency, medium stringency, high stringency, or very high stringency conditions" describes conditions for hybridization and washing. Guidance for performing hybridization reactions can be found in Current Protocols in Molecular Biology, John Wiley & Sons, N.Y. (1989), 6.3.1-6.3.6. Aqueous and nonaqueous methods are described in that reference and either method can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2.×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions unless otherwise specified.

The term "isolated" as used herein with respect to nucleic acids, such as DNA or RNA, refers to molecules separated from other DNAs or RNAs, respectively, that are present in the natural source of the nucleic acid. Moreover, by an "isolated nucleic acid" is meant to include nucleic acid fragments, which are not naturally occurring as fragments and would not be found in the natural state. The term "isolated" is also used herein to refer to polypeptides, which are isolated from other cellular proteins and is meant to encompass both purified and recombinant polypeptides. The term "isolated" as used herein also refers to a nucleic acid or peptide that is substantially free of cellular material, viral material, or culture medium when produced by recombinant DNA techniques. The term "isolated" as used herein also refers to a nucleic acid or peptide that is substantially free of chemical precursors or other chemicals when chemically synthesized. The term "isolated", as used herein with respect to products, such as fatty alcohols, refers to products that are isolated from cellular components, cell culture media, or chemical or synthetic precursors.

As used herein, the "level of expression of a gene in a cell" refers to the level of mRNA, pre-mRNA nascent transcript(s), transcript processing intermediates, mature mRNA(s), and degradation products encoded by the gene in the cell.

As used herein, the term "microorganism" means prokaryotic and eukaryotic microbial species from the domains Archaea, Bacteria and Eucarya, the latter including yeast and filamentous fungi, protozoa, algae, or higher Protista. The terms "microbial cells" (i.e., cells from microbes) and "microbes" are used interchangeably and refer to cells or small organisms that can only be seen with the aid of a microscope.

As used herein, the term "nucleic acid" refers to polynucleotides, such as deoxyribonucleic acid (DNA), and, where appropriate, ribonucleic acid (RNA). The term should also be understood to include, as equivalents, analogs of either RNA or DNA made from nucleotide analogs, and, as applicable to the embodiment being described, single (sense or antisense) and double-stranded polynucleotides, ESTs, chromosomes, cDNAs, mRNAs, and rRNAs.

As used herein, the term "operably linked" means that selected nucleotide sequence (e.g., encoding a polypeptide described herein) is in proximity with a promoter to allow the promoter to regulate expression of the selected DNA. In addition, the promoter is located upstream of the selected nucleotide sequence in terms of the direction of transcription and translation. By "operably linked" is meant that a nucleotide sequence and a regulatory sequence(s) are connected in such a way as to permit gene expression when the appropriate molecules (e.g., transcriptional activator proteins) are bound to the regulatory sequence(s).

The term "or" is used herein to mean, and is used interchangeably with, the term "and/or," unless context clearly indicates otherwise.

As used herein, "overexpress" means to express or cause to be expressed a nucleic acid, polypeptide, or hydrocarbon in a cell at a greater concentration than is normally expressed in a corresponding wild-type cell. For example, a polypeptide can be "overexpressed" in a recombinant host cell when the polypeptide is present in a greater concentration in the recombinant host cell compared to its concentration in a non-recombinant host cell of the same species.

As used herein, "partition coefficient" or "P," is defined as the equilibrium concentration of a compound in an organic phase divided by the concentration at equilibrium in an aqueous phase (e.g., fermentation broth). In one embodiment of a bi-phasic system described herein, the organic phase is formed by the fatty aldehyde during the production process. However, in some examples, an organic phase can be provided, such as by providing a layer of octane, to facilitate product separation. When describing a two phase system, the partition characteristics of a compound can be described as log P. For example, a compound with a log P of 1 would partition 10:1 to the organic phase. A compound with a log P of −1 would partition 1:10 to the organic phase. By choosing an appropriate fermentation broth and organic phase, a fatty aldehyde with a high log P value can separate into the organic phase even at very low concentrations in the fermentation vessel.

As used herein, the term "purify," "purified," or "purification" means the removal or isolation of a molecule from its environment by, for example, isolation or separation. "Substantially purified" molecules are at least about 60% free, preferably at least about 75% free, and more preferably at least about 90% free from other components with which they are associated. As used herein, these terms also refer to the removal of contaminants from a sample. For example, the removal of contaminants can result in an increase in the percentage of fatty alcohol in a sample. For example, when fatty alcohols are produced in a host cell, the fatty alcohols can be purified by the removal of host cell proteins. After purification, the percentage of fatty alcohols in the sample is increased.

The terms "purify," "purified," and "purification" do not require absolute purity. They are relative terms. Thus, for example, when fatty alcohols are produced in host cells, a purified fatty alcohol is one that is substantially separated from other cellular components (e.g., nucleic acids, polypeptides, lipids, carbohydrates, or other hydrocarbons). In another example, a purified fatty alcohol preparation is one in which the fatty alcohol is substantially free from contaminants, such as those that might be present following fermentation. In some embodiments, a fatty alcohol is purified when at least about 50% by weight of a sample is composed of the fatty alcohol. In other embodiments, a fatty alcohol is purified when at least about 60%, 70%, 80%, 85%, 90%, 92%, 95%, 98%, or 99% or more by weight of a sample is composed of the fatty alcohol.

As used herein, the term "recombinant polypeptide" refers to a polypeptide that is produced by recombinant DNA techniques, wherein generally DNA encoding the expressed protein or RNA is inserted into a suitable expression vector and that is in turn used to transform a host cell to produce the polypeptide or RNA.

As used herein, the term "substantially identical" (or "substantially homologous") is used to refer to a first amino acid or nucleotide sequence that contains a sufficient number of identical or equivalent (e.g., with a similar side chain, e.g., conserved amino acid substitutions) amino acid residues or nucleotides to a second amino acid or nucleotide sequence such that the first and second amino acid or nucleotide sequences have similar activities.

As used herein, the term "synthase" means an enzyme which catalyzes a synthesis process. As used herein, the term synthase includes synthases, synthetases, and ligases.

As used herein, the term "transfection" means the introduction of a nucleic acid (e.g., via an expression vector) into a recipient cell by nucleic acid-mediated gene transfer.

As used herein, "transformation" refers to a process in which a cell's genotype is changed as a result of the cellular uptake of exogenous DNA or RNA. This may result in the transformed cell expressing a recombinant form of an RNA or polypeptide. In the case of antisense expression from the transferred gene, the expression of a naturally-occurring form of the polypeptide is disrupted.

As used herein, a "transport protein" is a polypeptide that facilitates the movement of one or more compounds in and/or out of a cellular organelle and/or a cell.

As used herein, a "variant" of polypeptide X refers to a polypeptide having the amino acid sequence of peptide X in which one or more amino acid residues is altered. The variant may have conservative changes or nonconservative changes. Guidance in determining which amino acid residues may be substituted, inserted, or deleted without affecting biological activity may be found using computer programs well known in the art, for example, LASERGENE software (DNASTAR).

The term "variant," when used in the context of a polynucleotide sequence, may encompass a polynucleotide sequence related to that of a gene or the coding sequence thereof. This definition may also include, for example, "allelic," "splice," "species," or "polymorphic" variants. A splice variant may have significant identity to a reference polynucleotide, but will generally have a greater or fewer number of polynucleotides due to alternative splicing of exons during mRNA processing. The corresponding polypeptide may possess additional functional domains or an absence of domains. Species variants are polynucleotide sequences that vary from one species to another. The resulting polypeptides generally will have significant amino acid identity relative to each other. A polymorphic variant is a variation in the polynucleotide sequence of a particular gene between individuals of a given species.

As used herein, the term "vector" refers to a nucleic acid molecule capable of transporting another nucleic acid to which it has been linked. One type of useful vector is an episome (i.e., a nucleic acid capable of extra-chromosomal replication). Useful vectors are those capable of autonomous replication and/or expression of nucleic acids to which they are linked. Vectors capable of directing the expression of genes to which they are operatively linked are referred to herein as "expression vectors". In general, expression vectors of utility in recombinant DNA techniques are often in the form of "plasmids," which refer generally to circular double stranded DNA loops that, in their vector form, are not bound to the chromosome. In the present specification, "plasmid" and "vector" are used interchangeably, as the plasmid is the most commonly used form of vector. However, also included are such other forms of expression vectors that serve equivalent functions and that become known in the art subsequently hereto.

Figure 3:
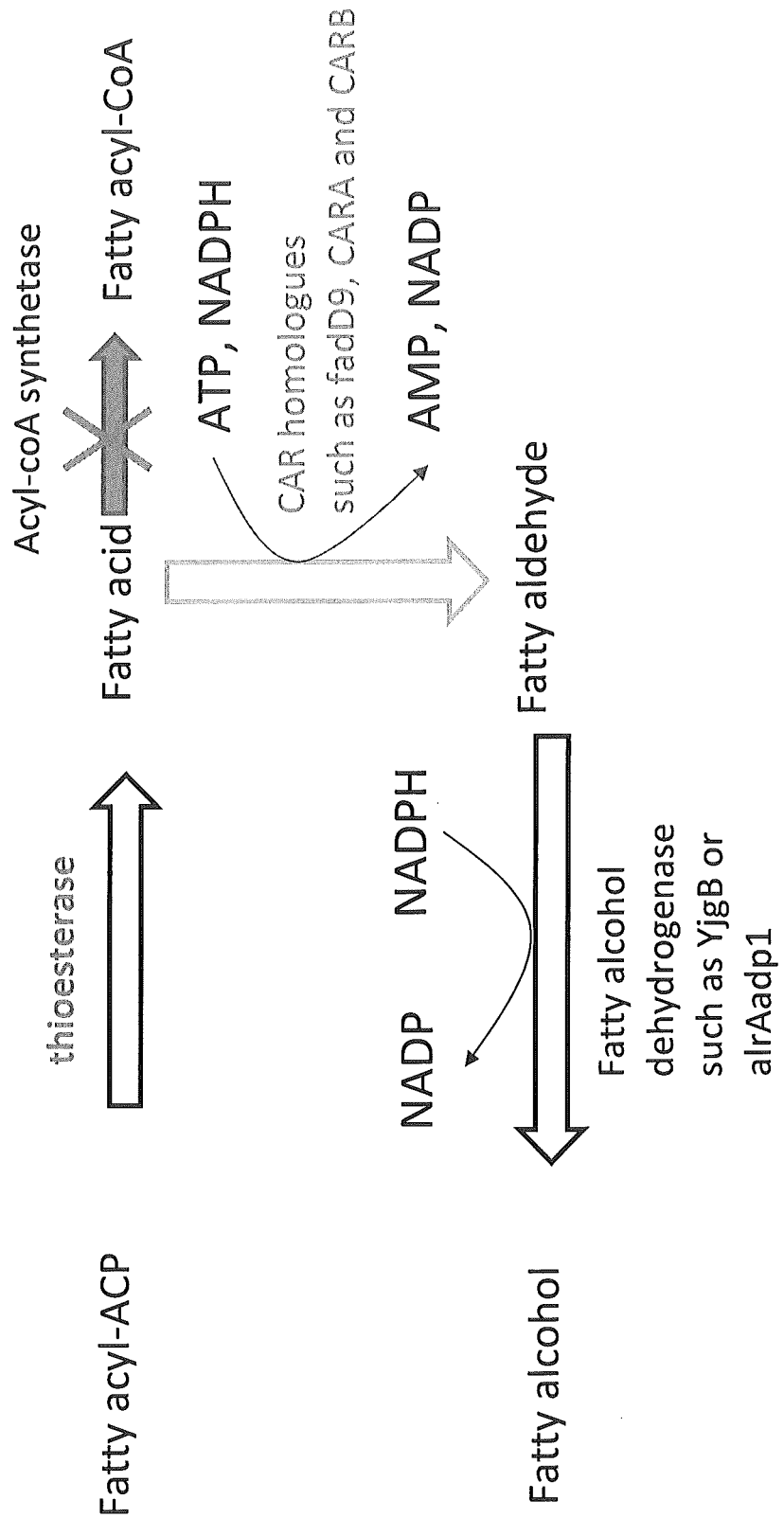
FIG. 3 is a schematic of a new pathway for fatty alcohol production.

The invention is based, at least in part, on the discovery of a new pathway for fatty alcohol biosynthesis in *E. coli* that utilize, in part, genes that encode fatty aldehyde biosynthetic polypeptides. The fatty alcohols can be produced by a biosynthetic pathway depicted in FIG. 3. In this pathway, a fatty acid is first activated by ATP and then reduced by a carboxylic acid reductase (CAR)-like enzyme to generate a fatty aldehyde. The fatty aldehyde can then be further reduced into a fatty alcohol by an alcohol dehydrogenase(s), such as alrAadp1 or yjgB. As demonstrated herein, yjgB may be the presumed alcohol dehydrogenase, whose substrates includes fatty aldehydes, for example fatty aldehydes with carbon chain lengths from $C_{10}$ to $C_{18}$.

Fatty Aldehyde Biosynthetic Genes, Fatty Alcohol Biosynthetic Genes, and Variants The methods described herein can be used to produce fatty alcohols, for example, from fatty aldehydes. In some instances, a fatty aldehyde is produced by expressing a fatty aldehyde biosynthetic gene, for example, a carboxylic acid reductase gene (car gene), having a nucleotide sequence listed in FIGS. 6 and 8, as well as polynucleotide variants thereof. In some instances, the fatty aldehyde biosynthetic gene encodes one or more of the amino acid motifs depicted in FIG. 7. For example, the gene can encode a polypeptide comprising SEQ ID NO:7, SEQ ID NO:8, SEQ ID NO:9, and SEQ ID NO:10; SEQ ID NO:11; SEQ ID NO:12; SEQ ID NO:13; SEQ ID NO:14; and/or SEQ ID NO:7, SEQ ID NO:9, SEQ ID NO:10, and SEQ ID NO:11. SEQ ID NO:7 includes a reductase domain; SEQ ID NO:8 and SEQ ID NO:14 include a NADP binding domain; SEQ ID NO:9 includes a phosphopantetheine attachment site; and SEQ ID NO:10 includes an AMP binding domain.

In other instances, a fatty alcohol is produced by expressing a fatty alcohol biosynthetic gene, for example, having a nucleotide sequence listed in FIG. 10, or a variant thereof.

Variants can be naturally occurring or created in vitro. In particular, such variants can be created using genetic engineering techniques, such as site directed mutagenesis, random chemical mutagenesis, Exonuclease III deletion procedures, or standard cloning techniques. Alternatively, such variants, fragments, analogs, or derivatives can be created using chemical synthesis or modification procedures.

Methods of making variants are well known in the art. These include procedures in which nucleic acid sequences obtained from natural isolates are modified to generate nucleic acids that encode polypeptides having characteristics that enhance their value in industrial or laboratory applications. In such procedures, a large number of variant sequences having one or more nucleotide differences with respect to the sequence obtained from the natural isolate are generated and characterized. Typically, these nucleotide differences result in amino acid changes with respect to the polypeptides encoded by the nucleic acids from the natural isolates.

For example, variants can be created using error prone PCR (see, e.g., Leung et al., *Technique* 1:11-15, 1989; and Caldwell et al., *PCR Methods Applic.* 2:28-33, 1992). In error prone PCR, PCR is performed under conditions where the copying fidelity of the DNA polymerase is low, such that a high rate of point mutations is obtained along the entire length of the PCR product. Briefly, in such procedures, nucleic acids to be mutagenized (e.g., a fatty aldehyde biosynthetic polynucleotide sequence), are mixed with PCR primers, reaction buffer, $MgCl_2$, $MnCl_2$, Taq polymerase, and an appropriate concentration of dNTPs for achieving a high rate of point mutation along the entire length of the PCR product. For example, the reaction can be performed using 20 fmoles of nucleic acid to be mutagenized (e.g., a fatty aldehyde biosynthetic polynucleotide sequence), 30 pmole of each PCR primer, a reaction buffer comprising 50 mM KCl, 10 mM Tris HCl (pH 8.3), and 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR can be performed for 30 cycles of 94° C. for 1 min, 45° C. for 1 min, and 72° C. for 1 min. However, it will be appreciated that these parameters can be varied as appropriate. The mutagenized nucleic acids are then cloned into an appropriate vector and the activities of the polypeptides encoded by the mutagenized nucleic acids are evaluated.

Variants can also be created using oligonucleotide directed mutagenesis to generate site-specific mutations in any cloned DNA of interest. Oligonucleotide mutagenesis is described in, for example, Reidhaar-Olson et al., *Science* 241:53-57, 1988. Briefly, in such procedures a plurality of double stranded oligonucleotides bearing one or more mutations to be introduced into the cloned DNA are synthesized and inserted into the cloned DNA to be mutagenized (e.g., a fatty aldehyde biosynthetic polynucleotide sequence). Clones containing the mutagenized DNA are recovered, and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, for example, U.S. Pat. No. 5,965,408.

Still another method of generating variants is sexual PCR mutagenesis. In sexual PCR mutagenesis, forced homologous recombination occurs between DNA molecules of different, but highly related, DNA sequence in vitro as a result of random fragmentation of the DNA molecule based on sequence homology. This is followed by fixation of the crossover by primer extension in a PCR reaction. Sexual PCR mutagenesis is described in, for example, Stemmer, *PNAS, USA* 91:1074740751, 1994.

Variants can also be created by in vivo mutagenesis. In some embodiments, random mutations in a nucleic acid sequence are generated by propagating the sequence in a bacterial strain, such as an *E. coli* strain, which carries mutations in one or more of the DNA repair pathways. Such "mutator" strains have a higher random mutation rate than that of a wild-type strain. Propagating a DNA sequence (e.g., a fatty aldehyde biosynthetic polynucleotide sequence) in one of these strains will eventually generate random mutations within the DNA. Mutator strains suitable for use for in vivo mutagenesis are described in, for example, PCT Publication No. WO 91/16427.

Variants can also be generated using cassette mutagenesis. In cassette mutagenesis, a small region of a double stranded DNA molecule is replaced with a synthetic oligonucleotide "cassette" that differs from the native sequence. The oligonucleotide often contains a completely and/or partially randomized native sequence.

Recursive ensemble mutagenesis can also be used to generate variants. Recursive ensemble mutagenesis is an algorithm for protein engineering (i.e., protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in, for example, Arkin et al., *PNAS, USA* 89:7811-7815, 1992.

In some embodiments, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in, for example, Delegrave et al., *Biotech. Res.* 11:1548-1552, 1993. Random and site-directed mutagenesis are described in, for example, Arnold, *Curr. Opin. Biotech.* 4:450-455, 1993.

In some embodiments, variants are created using shuffling procedures wherein portions of a plurality of nucleic acids that encode distinct polypeptides are fused together to create chimeric nucleic acid sequences that encode chimeric polypeptides as described in, for example, U.S. Pat. Nos. 5,965,408 and 5,939,250.

Polynucleotide variants also include nucleic acid analogs. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine and 5-methyl-2'-deoxycytidine or 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered, morpholino ring, or peptide nucleic acids, in which the deoxyphosphate backbone is replaced by a pseudopeptide backbone and the four bases are retained. (See, e.g., Summerton et al., *Antisense Nucleic Acid Drug Dev.* (1997) 7:187-195; and Hyrup et al., *Bioorgan. Med. Chem.* (1996) 4:5-23.) In addition, the deoxyphosphate backbone can be replaced with, for example, a phosphorothioate or phosphorodithioate backbone, a phosphoroamidite, or an alkyl phosphotriester backbone.

Any polynucleotide sequence encoding a homolog listed in FIGS. 6 and 8, or a variant thereof, can be used as a fatty aldehyde biosynthetic polynucleotide in the methods described herein. Any polynucleotide sequence listed in FIG. 10, or a variant, can be used as a fatty alcohol biosynthetic polynucleotide in the methods described herein.

Fatty Aldehyde Biosynthetic Polypeptides, Fatty Alcohol Biosynthetic Polypeptide, and Variants The methods described herein can also be used to produce fatty alcohols, for example, from fatty aldehydes. In some instances, the fatty aldehyde is produced by a fatty aldehyde biosynthetic polypeptide having an amino acid sequence listed in FIGS. 6 and 8, as well as polypeptide variants thereof. In some instances, a fatty aldehyde biosynthetic polypeptide is one that includes one or more of the amino acid motifs depicted in FIG. 7. For example, the polypeptide can include the amino acid sequences of SEQ ID NO:7, SEQ ID NO:8, SEQ ID NO:9, and SEQ ID NO:10. In other situations, the polypeptide includes one or more of SEQ ID NO:11, SEQ ID NO:12, SEQ ID NO:13, and SEQ ID NO:14. In yet other instances, the polypeptide includes the amino acid sequences of SEQ ID NO:7, SEQ ID NO:9, SEQ ID NO:10, and SEQ ID NO:11. SEQ ID NO:7 includes a reductase domain; SEQ ID NO:8 and SEQ ID NO:14 include a NADP binding domain; SEQ ID NO:9 includes a phosphopantetheine attachment site; and SEQ ID NO:10 includes an AMP binding domain.

In other instances, the methods described herein can be used to produce fatty alcohols using a fatty alcohol biosynthetic polypeptide having an amino acid sequence listed in FIG. 10, as well as polypeptide variants thereof.

Biosynthetic polypeptide variants can be variants in which one or more amino acid residues are substituted with a conserved or non-conserved amino acid residue (preferably a conserved amino acid residue). Such substituted amino acid residue may or may not be one encoded by the genetic code.

Conservative substitutions are those that substitute a given amino acid in a polypeptide by another amino acid of similar characteristics. Typical conservative substitutions are the following replacements: replacement of an aliphatic amino acid, such as alanine, valine, leucine, and isoleucine, with another aliphatic amino acid; replacement of a serine with a threonine or vice versa; replacement of an acidic residue, such as aspartic acid and glutamic acid, with another acidic residue;

replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue.

Other polypeptide variants are those in which one or more amino acid residues include a substituent group. Still other polypeptide variants are those in which the polypeptide is associated with another compound, such as a compound to increase the half-life of the polypeptide (e.g., polyethylene glycol).

Additional polypeptide variants are those in which additional amino acids are fused to the polypeptide, such as a leader sequence, a secretory sequence, a proprotein sequence, or a sequence which facilitates purification, enrichment, or stabilization of the polypeptide.

In some instances, the polypeptide variants retain the same biological function as a polypeptide having an amino acid sequence listed in FIGS. 6 and 8 (e.g., retain fatty aldehyde biosynthetic activity, such as carboxylic acid or fatty acid reductase activity), or listed in FIG. 10 (e.g., retain fatty alcohol biosynthetic activity, such as fatty alcohol dehydrogenase activity) and have amino acid sequences substantially identical thereto.

In other instances, the polypeptide variants have at least about 50%, at least about 55%, at least about 60%, at least about 65%, at least about 70%, at least about 75%, at least about 80%, at least about 85%, at least about 90%, at least about 95%, or more than about 95% homology to an amino acid sequence listed in FIGS. 6, 8, and/or 10. In another embodiment, the polypeptide variants include a fragment comprising at least about 5, 10, 15, 20, 25, 30, 35, 40, 50, 75, 100, or 150 consecutive amino acids thereof.

The polypeptide variants or fragments thereof can be obtained by isolating nucleic acids encoding them using techniques described herein or by expressing synthetic nucleic acids encoding them. Alternatively, polypeptide variants or fragments thereof can be obtained through biochemical enrichment or purification procedures. The sequence of polypeptide variants or fragments can be determined by proteolytic digestion, gel electrophoresis, and/or microsequencing. The sequence of the polypeptide variants or fragments can then be compared to an amino acid sequence listed in FIGS. 6, 8, and/or 10 using any of the programs described herein.

The polypeptide variants and fragments thereof can be assayed for fatty aldehyde-producing activity and/or fatty alcohol-producing activity using routine methods. For example, the polypeptide variants or fragment can be contacted with a substrate (e.g., a fatty acid, a fatty acid derivative substrate, or other substrate described herein) under conditions that allow the polypeptide variant to function. A decrease in the level of the substrate or an increase in the level of a fatty aldehyde can be measured to determine fatty aldehyde-producing activity. A decrease in the level of the substrate or an increase in the level of a fatty alcohol can be measured to determine fatty alcohol-producing activity.

Antibodies to Biosynthetic Polypeptides

The fatty aldehyde biosynthetic polypeptides described herein can also be used to produce antibodies directed against fatty aldehyde biosynthetic polypeptides. Such antibodies can be used, for example, to detect the expression of a fatty aldehyde biosynthetic polypeptide or fatty alcohol biosynthetic polypeptide using methods known in the art. The antibody can be, for example, a polyclonal antibody; a monoclonal antibody or antigen binding fragment thereof; a modified antibody such as a chimeric antibody, reshaped antibody, humanized antibody, or fragment thereof (e.g., Fab', Fab, F(ab')$_2$); or a biosynthetic antibody, for example, a single chain antibody, single domain antibody (DAB), Fv, single chain Fv (scFv), or the like.

Methods of making and using polyclonal and monoclonal antibodies are described, for example, in Harlow et al., *Using Antibodies: A Laboratory Manual: Portable Protocol I*. Cold Spring Harbor Laboratory (Dec. 1, 1998). Methods for making modified antibodies and antibody fragments (e.g., chimeric antibodies, reshaped antibodies, humanized antibodies, or fragments thereof, e.g., Fab', Fab, F(ab')$_2$ fragments); or biosynthetic antibodies (e.g., single chain antibodies, single domain antibodies (DABs), Fv, single chain Fv (scFv), and the like), are known in the art and can be found, for example, in Zola, *Monoclonal Antibodies: Preparation and Use of Monoclonal Antibodies and Engineered Antibody Derivatives*, Springer Verlag (Dec. 15, 2000; 1st edition).

Substrates

The compositions and methods described herein can be used to produce fatty alcohols, for example, from fatty aldehydes, which themselves can be produced from an appropriate substrate. While not wishing to be bound by theory, it is believed that the fatty aldehyde biosynthetic polypeptides described herein produce fatty aldehydes from substrates via a reduction mechanism. In some instances, the substrate is a fatty acid derivative (e.g., a fatty acid), and a fatty aldehyde having particular branching patterns and carbon chain length can be produced from a fatty acid derivative having those characteristics that would result in a particular fatty aldehyde. Through an additional reaction mechanism, the fatty aldehyde can be converted into the desired fatty alcohol (e.g., by a fatty alcohol biosynthetic polypeptide described herein).

Accordingly, each step within a biosynthetic pathway that leads to the production of a fatty acid derivative substrate can be modified to produce or overproduce the substrate of interest. For example, known genes involved in the fatty acid biosynthetic pathway or the fatty aldehyde pathway can be expressed, overexpressed, or attenuated in host cells to produce a desired substrate (see, e.g., PCT/US08/058,788). Exemplary genes are provided in FIG. 9.

Synthesis of Substrates

Fatty acid synthase (FAS) is a group of polypeptides that catalyze the initiation and elongation of acyl chains (Marrakchi et al., *Biochemical Society*, 30:1050-1055, 2002). The acyl carrier protein (ACP) along with the enzymes in the FAS pathway control the length, degree of saturation, and branching of the fatty acid derivatives produced. The fatty acid biosynthetic pathway involves the precursors acetyl-CoA and malonyl-CoA. The steps in this pathway are catalyzed by enzymes of the fatty acid biosynthesis (fab) and acetyl-CoA carboxylase (acc) gene families (see, e.g., Heath et al., *Prog. Lipid Res*. 40(6):467-97 (2001)).

Host cells can be engineered to express fatty acid derivative substrates by recombinantly expressing or overexpressing one or more fatty acid synthase genes, such as acetyl-CoA and/or malonyl-CoA synthase genes. For example, to increase acetyl-CoA production, one or more of the following genes can be expressed in a host cell: pdh (a multienzyme complex comprising aceEF (which encodes the E1p dehydrogenase component, the E2p dihydrolipoamide acyltransferase component of the pyruvate and 2-oxoglutarate dehydrogenase complexes, and lpd), panK, fabH, fabB, fabD, fabG, acpP, and fabF. Exemplary GenBank accession numbers for these genes are: pdh (BAB34380, AAC73227, AAC73226), panK (also known as CoA, AAC76952), aceEF (AAC73227, AAC73226), fabH (AAC74175), fabB (P0A953), fabD (AAC74176), fabG (AAC74177), acpP (AAC74178), fabF (AAC74179). Additionally, the expression levels of fadE, gpsA, ldhA, pflb, adhE, pta, poxB, ackA, and/or ackB can be attenuated or knocked-out in an engineered host cell by transformation with conditionally replicative or non-replicative plasmids containing null or deletion mutations of the corresponding genes or by substituting promoter or enhancer sequences. Exemplary GenBank accession numbers for these genes are: fadE (AAC73325), gspA (AAC76632), ldhA (AAC74462), pflb (AAC73989), adhE (AAC74323), pta (AAC75357), poxB (AAC73958), ackA (AAC75356), and ackB (BAB81430). The resulting host cells will have increased acetyl-CoA production levels when grown in an appropriate environment.

Malonyl-CoA overexpression can be affected by introducing accABCD (e.g., accession number AAC73296, EC 6.4.1.2) into a host cell. Fatty acids can be further overexpressed in host cells by introducing into the host cell a DNA sequence encoding a lipase (e.g., accession numbers CAA89087, CAA98876).

In addition, inhibiting PlsB can lead to an increase in the levels of long chain acyl-ACP, which will inhibit early steps in the pathway (e.g., accABCD, fabH, and fabI). The plsB (e.g., accession number AAC77011) D311E mutation can be used to increase the amount of available fatty acids.

In addition, a host cell can be engineered to overexpress a sfa gene (suppressor of fabA, e.g., accession number AAN79592) to increase production of monounsaturated fatty acids (Rock et al., *J. Bacteriology* 178:5382-5387, 1996).

The chain length of a fatty acid derivative substrate can be selected for by modifying the expression of selected thioesterases. Thioesterase influences the chain length of fatty acids produced. Hence, host cells can be engineered to express, overexpress, have attenuated expression, or not to express one or more selected thioesterases to increase the production of a preferred fatty acid derivative substrate. For example, $C_{10}$ fatty acids can be produced by expressing a thioesterase that has a preference for producing $C_{10}$ fatty acids and attenuating thioesterases that have a preference for producing fatty acids other than $C_{10}$ fatty acids (e.g., a thioesterase which prefers to produce $C_{14}$ fatty acids). This would result in a relatively homogeneous population of fatty acids that have a carbon chain length of 10. In other instances, $C_{14}$ fatty acids can be produced by attenuating endogenous thioesterases that produce non-$C_{14}$ fatty acids and expressing the thioesterases that use $C_{14}$-ACP. In some situations, $C_{12}$ fatty acids can be produced by expressing thioesterases that use $C_{12}$-ACP and attenuating thioesterases that produce non-$C_{12}$ fatty acids. Acetyl-CoA, malonyl-CoA, and fatty acid overproduction can be verified using methods known in the art, for example, by using radioactive precursors, HPLC, or GC-MS subsequent to cell lysis. Non-limiting examples of thioesterases that can be used in the methods described herein are listed in Table 1.

TABLE 1

| Thioesterases | | |
|---|---|---|
| Accession Number | Source Organism | Gene |
| AAC73596 | *E. coli* | tesA without leader sequence |
| AAC73555 | *E. coli* | tesB |
| Q41635, AAA34215 | *Umbellularia california* | fatB |
| AAC49269 | *Cuphea hookeriana* | fatB2 |
| Q39513; AAC72881 | *Cuphea hookeriana* | fatB3 |
| Q39473, AAC49151 | *Cinnamonum camphorum* | fatB |

TABLE 1-continued

| Thioesterases | | |
|---|---|---|
| Accession Number | Source Organism | Gene |
| CAA85388 | *Arabidopsis thaliana* | fatB [M141T]* |
| NP_189147; NP_193041 | *Arabidopsis thaliana* | fatA |
| CAC39106 | *Bradyrhiizobium japonicum* | fatA |
| AAC72883 | *Cuphea hookeriana* | fatA |
| AAL79361 | *Helianthus annus* | fatA1 |

*Mayer et al., *BMC Plant Biology* 7: 1-11, 2007

In other instances, a fatty aldehyde biosynthetic polypeptide, variant, or a fragment thereof, is expressed in a host cell that contains a naturally occurring mutation that results in an increased level of fatty acids in the host cell. In some instances, the host cell is genetically engineered to increase the level of fatty acids in the host cell relative to a corresponding wild-type host cell. For example, the host cell can be genetically engineered to express a reduced level of an acyl-CoA synthase relative to a corresponding wild-type host cell. In one embodiment, the level of expression of one or more genes (e.g., an acyl-CoA synthase gene) is reduced by genetically engineering a "knock out" host cell.

Any known acyl-CoA synthase gene can be reduced or knocked out in a host cell. Non-limiting examples of acyl-CoA synthase genes include fadD, fadK, BH3103, yhfL, Pfl-4354, EAV15023, fadD1, fadD2, RPC_4074, fadDD35, fadDD22, faa3p or the gene encoding the protein ZP_01644857. Specific examples of acyl-CoA synthase genes include fadDD35 from *M. tuberculosis* H37Rv [NP_217021], fadDD22 from *M. tuberculosis* H37Rv [NP_217464], fadD from *E. coli* [NP_416319], fadK from *E. coli* [YP_416216], fadD from *Acinetobacter* sp. ADP1 [YP_045024], fadD from *Haemophilus influenza* RdkW20 [NP_438551], fadD from *Rhodopseudomonas palustris* Bis B18 [YP_533919], BH3101 from *Bacillus halodurans* C-125 [NP_243969], Pfl-4354 from *Pseudomonas fluorescens* Pfo-1 [YP_350082], EAV15023 from *Comamonas testosterone* KF-1 [ZP_01520072], yhfL from *B. subtilis* [NP_388908], fadD1 from *P. aeruginosa* PAO1 [NP_251989], fadD1 from *Ralstonia solanacearum* GM1 1000 [NP_520978], fadD2 from *P. aeruginosa* PAO1 [NP_251990], the gene encoding the protein ZP_01644857 from *Stenotrophomonas maltophilia* R551-3, faa3p from *Saccharomyces cerevisiae* [NP_012257], faa1p from *Saccharomyces cerevisiae* [NP_014962], lcfA from *Bacillus subtilis* [CAA99571], or those described in Shockey et al., *Plant. Physiol.* 129:1710-1722, 2002; Caviglia et al., *J. Biol. Chem.* 279:1163-1169, 2004; Knoll et al., *J. Biol. Chem.* 269(23):16348-56, 1994; Johnson et al., *J. Biol. Chem.* 269: 18037-18046, 1994; and Black et al., *J. Biol. Chem.* 267: 25513-25520, 1992.

Formation of Branched Fatty Alcohols

Fatty alcohols can be produced from fatty aldehydes that contain branch points by using branched fatty acid derivatives as substrates for a fatty aldehyde biosynthetic polypeptide described herein. For example, although *E. coli* naturally produces straight chain fatty acids (sFAs), *E. coli* can be engineered to produce branched chain fatty acids (brFAs) by introducing and expressing or overexpressing genes that provide branched precursors in the *E. coli* (e.g., bkd, ilv, icm, and fab gene families). Additionally, a host cell can be engineered to express or overexpress genes encoding proteins for the elongation of brFAs (e.g., ACP, FabF, etc.) and/or to delete or attenuate the corresponding host cell genes that normally lead to sFAs.

The first step in forming brFAs is the production of the corresponding α-keto acids by a branched-chain amino acid aminotransferase. Host cells may endogenously include genes encoding such enzymes or such genes can be recombinantly introduced. E. coli, for example, endogenously expresses such an enzyme, IlvE (EC 2.6.1.42; GenBank accession YP_026247). In some host cells, a heterologous branched-chain amino acid aminotransferase may not be expressed. However, E. coli IlvE or any other branched-chain amino acid aminotransferase (e.g., IlvE from Lactococcus lactis (GenBank accession AAF34406), IlvE from Pseudomonas putida (GenBank accession NP_745648), or IlvE from Streptomyces coelicolor (GenBank accession NP_629657)), if not endogenous, can be introduced.

In another embodiment, the production of α-keto acids can be achieved by using the methods described in Atsumi et al., Nature 451:86-89, 2008. For example, 2-ketoisovalerate can be produced by overexpressing the genes encoding IlvI, INH, IlvC, or IlvD. In another example, 2-keto-3-methyl-valerate can be produced by overexpressing the genes encoding IlvA and IlvI, IlvH (or AlsS of Bacillus subtilis), INC, IlvD, or their corresponding homologs. In a further embodiment, 2-keto-4-methyl-pentanoate can be produced by overexpressing the genes encoding IlvI, IlvH, IlvC, IlvD and LeuA, LeuB, LeuC, LeuD, or their corresponding homologs.

The second step is the oxidative decarboxylation of the α-keto acids to the corresponding branched-chain acyl-CoA. This reaction can be catalyzed by a branched-chain α-keto acid dehydrogenase complex (bkd; EC 1.2.4.4.) (Denoya et al., J. Bacteriol. 177:3504, 1995), which consists of E1α/β (decarboxylase), E2 (dihydrolipoyl transacylase), and E3 (dihydrolipoyl dehydrogenase) subunits. These branched-chain α-keto acid dehydrogenase complexes are similar to pyruvate and α-ketoglutarate dehydrogenase complexes. Any microorganism that possesses brFAs and/or grows on branched-chain amino acids can be used as a source to isolate bkd genes for expression in host cells, for example, E. coli. Furthermore, E. coli has the E3 component as part of its pyruvate dehydrogenase complex (lpd, EC 1.8.1.4, GenBank accession NP_414658). Thus, it may be sufficient to express only the E1 α/β and E2 bkd genes. Table 2 lists non-limiting examples of bkd genes from several microorganisms that can be recombinantly introduced and expressed in a host cell to provide branched-chain acyl-CoA precursors.

TABLE 2

Bkd genes from selected microorganisms

| Organism | Gene | GenBank Accession # |
|---|---|---|
| Streptomyces coelicolor | bkdA1 (E1α) | NP_628006 |
|  | bkdB1 (E1β) | NP_628005 |
|  | bkdC1 (E2) | NP_638004 |
| Streptomyces coelicolor | bkdA2 (E1α) | NP_733618 |
|  | bkdB2 (E1β) | NP_628019 |
|  | bkdC2 (E2) | NP_628018 |
| Streptomyces avermitilis | bkdA (E1a) | BAC72074 |
|  | bkdB (E1b) | BAC72075 |
|  | bkdC (E2) | BAC72076 |
| Streptomyces avermitilis | bkdF (E1α) | BAC72088 |
|  | bkdG (E1β) | BAC72089 |
|  | bkdH (E2) | BAC72090 |
| Bacillus subtilis | bkdAA (E1α) | NP_390288 |
|  | bkdAB (E1β) | NP_390288 |
|  | bkdB (E2) | NP_390288 |
| Pseudomonas putida | bkdA1 (E1α) | AAA65614 |
|  | bkdA2 (E1β) | AAA65615 |
|  | bkdC (E2) | AAA65617 |

In another example, isobutyryl-CoA can be made in a host cell, for example in E. coli, through the coexpression of a crotonyl-CoA reductase (Ccr, EC 1.6.5.5, 1.1.1.1) and isobutyryl-CoA mutase (large subunit IcmA, EC 5.4.99.2; small subunit IcmB, EC 5.4.99.2) (Han and Reynolds, J. Bacteriol. 179:5157, 1997). Crotonyl-CoA is an intermediate in fatty acid biosynthesis in E. coli and other microorganisms. Non-limiting examples of ccr and icm genes from selected microorganisms are listed in Table 3.

TABLE 3

Ccr and icm genes from selected microorganisms

| Organism | Gene | GenBank Accession # |
|---|---|---|
| Streptomyces coelicolor | ccr | NP_630556 |
|  | icmA | NP_629554 |
|  | icmB | NP_630904 |
| Streptomyces cinnamonensis | ccr | AAD53915 |
|  | icmA | AAC08713 |
|  | icmB | AJ246005 |

In addition to expression of the bkd genes, the initiation of brFA biosynthesis utilizes β-ketoacyl-acyl-carrier-protein synthase III (FabH, EC 2.3.1.41) with specificity for branched chain acyl-CoAs (Li et al., J. Bacteriol. 187:3795-3799, 2005). Non-limiting examples of such FabH enzymes are listed in Table 4. fabH genes that are involved in fatty acid biosynthesis of any brFA-containing microorganism can be expressed in a host cell. The Bkd and FabH enzymes from host cells that do not naturally make brFA may not support brFA production. Therefore, bkd and fabH can be expressed recombinantly. Vectors containing the bkd and fabH genes can be inserted into such a host cell. Similarly, the endogenous level of Bkd and FabH production may not be sufficient to produce brFA. In this case, they can be overexpressed. Additionally, other components of the fatty acid biosynthesis pathway can be expressed or overexpressed, such as acyl carrier proteins (ACPs) and β-ketoacyl-acyl-carrier-protein synthase II (fabF, EC 2.3.1.41) (non-limiting examples of candidates are listed in Table 4). In addition to expressing these genes, some genes in the endogenous fatty acid biosynthesis pathway can be attenuated in the host cell (e.g., the E. coli genes fabH (GenBank accession #NP_415609) and/or fabF (GenBank accession #NP_415613)).

TABLE 4

FabH, ACP and fabF genes from selected microorganisms with brFAs

| Organism | Gene | GenBank Accession # |
|---|---|---|
| Streptomyces coelicolor | fabH1 | NP_626634 |
|  | acp | NP_626635 |
|  | fabF | NP_626636 |
| Streptomyces avermitilis | fabH3 | NP_823466 |
|  | fabC3 (acp) | NP_823467 |
|  | fabF | NP_823468 |
| Bacillus subtilis | fabH_A | NP_389015 |
|  | fabH_B | NP_388898 |
|  | acp | NP_389474 |
|  | fabF | NP_389016 |
| Stenotrophomonas maltophilia | SmalDRAFT_0818 (fabH) | ZP_01643059 |
|  | SmalDRAFT_0821 (acp) | ZP_01643063 |
|  | SmalDRAFT_0822 (fabF) | ZP_01643064 |
| Legionella pneumophila | fabH | YP_123672 |
|  | acp | YP_123675 |
|  | fabF | YP_123676 |

Formation of Cyclic Fatty Alcohols

Cyclic fatty alcohols can be produced from cyclic fatty aldehydes using cyclic fatty acid derivatives as substrates for a fatty aldehyde biosynthetic polypeptide described herein. To produce cyclic fatty acid derivative substrates, genes that provide cyclic precursors (e.g., the ans, chc, and plm gene families) can be introduced into the host cell and expressed to allow initiation of fatty acid biosynthesis from cyclic precursors. For example, to convert a host cell, such as *E. coli*, into one capable of synthesizing w-cyclic fatty acids (cyFA), a gene that provides the cyclic precursor cyclohexylcarbonyl-CoA (CHC-CoA) (Cropp et al., *Nature Biotech.* 18:980-983, 2000) can be introduced and expressed in the host cell. Non-limiting examples of genes that provide CHC-CoA in *E. coli* include: ansJ, ansK, ansL, chcA, and ansM from the ansatrienin gene cluster of *Streptomyces collinus* (Chen et al., *Eur. J. Biochem.* 261: 98-107, 1999) or plmJ, plmK, plmL, chcA, and plmM from the phoslactomycin B gene cluster of *Streptomyces* sp. HK803 (Palaniappan et al., *J. Biol. Chem.* 278: 35552-35557, 2003) together with the chcB gene (Patton et al., *Biochem.* 39:7595-7604, 2000) from *S. collinus, S. avermitilis,* or *S. coelicolor* (see Table 5). The genes listed in Table 4 can then be expressed to allow initiation and elongation of ω-cyclic fatty acids. Alternatively, the homologous genes can be isolated from microorganisms that make cyFA and expressed in a host cell (e.g., *E. coli*).

TABLE 5

Genes for the synthesis of CHC-CoA

| Organism | Gene | GenBank Accession # |
|---|---|---|
| *Streptomyces collinus* | ansJK | U72144* |
|  | ansL |  |
|  | chcA |  |
|  | ansM |  |
|  | chcB | AF268489 |
| *Streptomyces* sp. HK803 | pmlJK | AAQ84158 |
|  | pmlL | AAQ84159 |
|  | chcA | AAQ84160 |
|  | pmlM | AAQ84161 |
| *Streptomyces coelicolor* | chcB/caiD | NP_629292 |
| *Streptomyces avermitilis* | chcB/caiD | NP_629292 |

*Only chcA is annotated in GenBank entry U72144, ansJKLM are according to Chen et al. (*Eur. J. Biochem.* 261: 98-107, 1999).

The genes listed in Table 4 (fabH, acp, and fabF) allow initiation and elongation of ω-cyclic fatty acids because they have broad substrate specificity. If the coexpression of any of these genes with the genes listed in Table 5 does not yield cyFA, then fabH, acp, and/or fabF homologs from microorganisms that make cyFAs (e.g., those listed in Table 6) can be isolated (e.g., by using degenerate PCR primers or heterologous DNA sequence probes) and coexpressed.

TABLE 6

Non-limiting examples of microorganisms that contain ω-cyclic fatty acids

| Organism | Reference |
|---|---|
| *Curtobacterium pusillum* | ATCC19096 |
| *Alicyclobacillus acidoterrestris* | ATCC49025 |
| *Alicyclobacillus acidocaldarius* | ATCC27009 |
| *Alicyclobacillus cycloheptanicus** | Moore, *J. Org. Chem.* 62: pp. 2173, 1997. |

*Uses cycloheptylcarbonyl-CoA and not cyclohexylcarbonyl-CoA as precursor for cyFA biosynthesis.

Fatty Alcohol Saturation Levels

The degree of saturation in fatty acids (which can then be converted into fatty aldehydes and then fatty alcohols as described herein) can be controlled by regulating the degree of saturation of fatty acid intermediates. For example, the sfa, gns, and fab families of genes can be expressed, overexpressed, or expressed at reduced levels, to control the saturation of fatty acids. FIG. 9 lists non-limiting examples of genes in these gene families that may be used in the methods and host cells described herein.

For example, host cells can be engineered to produce unsaturated fatty acids by engineering the production host to overexpress fabB or by growing the production host at low temperatures (e.g., less than 37° C.). FabB has preference to cis-δ3decenoyl-ACP and results in unsaturated fatty acid production in *E. coli*. Overexpression of fabB results in the production of a significant percentage of unsaturated fatty acids (de Mendoza et al., *J. Biol. Chem.* 258:2098-2101, 1983). The gene fabB may be inserted into and expressed in host cells not naturally having the gene. These unsaturated fatty acids can then be used as intermediates in host cells that are engineered to produce fatty acid derivatives, such as fatty aldehydes.

In other instances, a repressor of fatty acid biosynthesis, for example, fabR (GenBank accession NP_418398), can be deleted, which will also result in increased unsaturated fatty acid production in *E. coli* (Zhang et al., *J. Biol. Chem.* 277: 15558, 2002). Similar deletions may be made in other host cells. A further increase in unsaturated fatty acids may be achieved, for example, by overexpressing fabM (trans-2, cis-3-decenoyl-ACP isomerase, GenBank accession DAA05501) and controlled expression of fabK (trans-2-enoyl-ACP reductase II, GenBank accession NP_357969) from *Streptococcus pneumoniae* (Marrakchi et al., *J. Biol. Chem.* 277: 44809, 2002), while deleting *E. coli* fabI (trans-2-enoyl-ACP reductase, GenBank accession NP_415804). In some examples, the endogenous fabF gene can be attenuated, thus increasing the percentage of palmitoleate (C16:1) produced.

In yet other examples, host cells can be engineered to produce saturated fatty acids by reducing the expression of an sfa, gns, and/or fab gene.

In some instances, a host cell can be engineered to express an attenuated level of a dehydratase/isomerase and/or a ketoacyl-ACP synthase. For example, a host cell can be engineered to express a decreased level of fabA and/orfabB. In some instances, the host cell can be grown in the presence of unsaturated fatty acids. In other instances, the host cell can be further engineered to express or overexpress a gene encoding a desaturase enzyme. One nonlimiting example of a desaturase is *B. subtilis* DesA (AF037430). Other genes encoding desaturase enzymes are known in the art and can be used in the host cells and methods described herein, such as desaturases that use acyl-ACP, such as hexadecanoyl-ACP or octadecanoyl-ACP. The saturated fatty acids can be used to produce fatty acid derivatives, such as fatty aldehydes, and subsequently saturated fatty alcohols, as described herein.

Production of Fatty Alcohols

A fatty aldehyde described herein can be converted into a fatty alcohol by an alcohol dehydrogenase. In some examples, a gene encoding a fatty aldehyde biosynthetic polypeptide described herein can be expressed in a host cell that expresses an endogenous alcohol dehydrogenase capable of converting a fatty aldehyde produced by the fatty aldehyde biosynthetic polypeptide into a corresponding fatty alcohol. In other instances, a gene encoding a fatty alcohol biosynthetic polypeptide described herein, such as an amino acid sequence listed in FIG. 10 or a variant thereof, can be expressed in a host cell. Exemplary fatty alcohol biosynthetic genes include, but are not limited to, AlrA of *Acenitobacter* sp. M-1 or AlrA homologs; and endogenous *E. coli* alcohol dehydrogenases such as DkgA (NP_417485), DkgB (NP_414743), YjgB, (AAC77226), YdjL (AAC74846), YdjJ (NP_416288), AdhP (NP_415995), YhdH (NP_417719), YahK (NP_414859), YphC (AAC75598), and YqhD (Q46856). In other instances, a gene encoding a fatty alcohol biosynthetic polypeptide can be co-expressed in a host cell with a gene encoding a fatty aldehyde biosynthetic polypeptide described herein.

Genetic Engineering of Host Cells to Produce Fatty Alcohols

Various host cells can be used to produce fatty alcohols, as described herein. A host cell can be any prokaryotic or eukaryotic cell. For example, a gene encoding a polypeptide described herein (e.g., a fatty aldehyde biosynthetic polypeptide and/or a fatty alcohol biosynthetic polypeptide) can be expressed in bacterial cells (such as *E. coli*), insect cells, yeast, or mammalian cells (such as Chinese hamster ovary cells (CHO) cells, COS cells, VERO cells, BHK cells, HeLa cells, Cv1 cells, MDCK cells, 293 cells, 3T3 cells, or PC12 cells). Other exemplary host cells include cells from the members of the genus *Escherichia, Bacillus, Lactobacillus, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Schizosaccharomyces, Yarrowia,* or *Streptomyces*. Yet other exemplary host cells can be a *Bacillus lentus* cell, a *Bacillus brevis* cell, a *Bacillus stearothermophilus* cell, a *Bacillus licheniformis* cell, a *Bacillus alkalophilus* cell, a *Bacillus coagulans* cell, a *Bacillus circulans* cell, a *Bacillus pumilis* cell, a *Bacillus thuringiensis* cell, a *Bacillus clausii* cell, a *Bacillus megaterium* cell, a *Bacillus subtilis* cell, a *Bacillus amyloliquefaciens* cell, a *Trichoderma koningii* cell, a *Trichoderma viride* cell, a *Trichoderma reesei* cell, a *Trichoderma longibrachiatum* cell, an *Aspergillus awamori* cell, an *Aspergillus fumigates* cell, an *Aspergillus foetidus* cell, an *Aspergillus nidulans* cell, an *Aspergillus niger* cell, an *Aspergillus oryzae* cell, a *Humicola insolens* cell, a *Humicola lanuginose* cell, a *Rhizomucor miehei* cell, a *Mucor michei* cell, a *Streptomyces lividans* cell, a *Streptomyces murinus* cell, or an *Actinomycetes* cell. Other host cells are cyanobacterial host cells.

In a preferred embodiment, the host cell is an *E. coli* cell, a *Saccharomyces cerevisiae* cell, or a *Bacillus subtilis* cell. In a more preferred embodiment, the host cell is from *E. coli* strains B, C, K, or W. Other suitable host cells are known to those skilled in the art.

Additional host cells that can be used in the methods described herein are described in WO2009/111513 and WO2009/111672.

Various methods well known in the art can be used to genetically engineer host cells to produce fatty alcohols. The methods can include the use of vectors, preferably expression vectors, containing a nucleic acid encoding a fatty aldehyde biosynthetic polypeptide and/or a fatty alcohol biosynthetic polypeptide described herein, polypeptide variant, or a fragment thereof. Those skilled in the art will appreciate a variety of viral vectors (for example, retroviral vectors, lentiviral vectors, adenoviral vectors, and adeno-associated viral vectors) and non-viral vectors can be used in the methods described herein.

The recombinant expression vectors described herein include a nucleic acid described herein in a form suitable for expression of the nucleic acid in a host cell. The recombinant expression vectors can include one or more control sequences, selected on the basis of the host cell to be used for expression. The control sequence is operably linked to the nucleic acid sequence to be expressed. Such control sequences are described, for example, in Goeddel, Gene Expression Technology: Methods in Enzymology 185, Academic Press, San Diego, Calif. (1990). Control sequences include those that direct constitutive expression of a nucleotide sequence in many types of host cells and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors described herein can be introduced into host cells to produce polypeptides, including fusion polypeptides, encoded by the nucleic acids as described herein.

Recombinant expression vectors can be designed for expression of a gene encoding a fatty aldehyde biosynthetic polypeptide (or variant) and/or a gene encoding a fatty alcohol biosynthetic polypeptide in prokaryotic or eukaryotic cells (e.g., bacterial cells, such as *E. coli*, insect cells (e.g., using baculovirus expression vectors), yeast cells, or mammalian cells). Suitable host cells are discussed further in Goeddel, Gene Expression Technology: Methods in Enzymology 185, Academic Press, San Diego, Calif. (1990). Alternatively, the recombinant expression vector can be transcribed and translated in vitro, for example, by using T7 promoter regulatory sequences and T7 polymerase.

Expression of genes encoding polypeptides in prokaryotes, for example, *E. coli*, is most often carried out with vectors containing constitutive or inducible promoters directing the expression of either fusion or non-fusion polypeptides. Fusion vectors add a number of amino acids to a polypeptide encoded therein, usually to the amino terminus of the recombinant polypeptide. Such fusion vectors typically serve three purposes: (1) to increase expression of the recombinant polypeptide; (2) to increase the solubility of the recombinant polypeptide; and (3) to aid in the purification of the recombinant polypeptide by acting as a ligand in affinity purification. Often, in fusion expression vectors, a proteolytic cleavage site is introduced at the junction of the fusion moiety and the recombinant polypeptide. This enables separation of the recombinant polypeptide from the fusion moiety after purification of the fusion polypeptide. Examples of such enzymes, and their cognate recognition sequences, include Factor Xa, thrombin, and enterokinase. Exemplary fusion expression vectors include pGEX (Pharmacia Biotech Inc; Smith et al., *Gene* (1988) 67:31-40), pMAL (New England Biolabs, Beverly, Mass.), and pRITS (Pharmacia, Piscataway, N.J.), which fuse glutathione S-transferase (GST), maltose E binding protein, or protein A, respectively, to the target recombinant polypeptide.

Examples of inducible, non-fusion *E. coli* expression vectors include pTrc (Amann et al., *Gene* (1988) 69:301-315) and pET 11d (Studier et al., Gene Expression Technology: Methods in Enzymology 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident λ prophage harboring a T7 gn1 gene under the transcriptional control of the lacUV 5 promoter.

One strategy to maximize recombinant polypeptide expression is to express the polypeptide in a host cell with an impaired capacity to proteolytically cleave the recombinant polypeptide (see Gottesman, Gene Expression Technology: Methods in Enzymology 185, Academic Press, San Diego, Calif. (1990) 119-128). Another strategy is to alter the nucleic acid sequence to be inserted into an expression vector so that the individual codons for each amino acid are those preferentially utilized in the host cell (Wada et al., *Nucleic Acids Res.* (1992) 20:2111-2118). Such alteration of nucleic acid sequences can be carried out by standard DNA synthesis techniques.

In another embodiment, the host cell is a yeast cell. In this embodiment, the expression vector is a yeast expression vector. Examples of vectors for expression in yeast *S. cerevisiae* include pYepSec1 (Baldari et al., *EMBO J.* (1987) 6:229-234), pMFa (Kurjan et al., *Cell* (1982) 30:933-943), pJRY88 (Schultz et al., Gene (1987) 54:113-123), pYES2 (Invitrogen Corporation, San Diego, Calif.), and picZ (Invitrogen Corp, San Diego, Calif.).

Alternatively, a polypeptide described herein can be expressed in insect cells using baculovirus expression vectors. Baculovirus vectors available for expression of proteins in cultured insect cells (e.g., Sf9 cells) include, for example, the pAc series (Smith et al., *Mol. Cell. Biol.* (1983) 3:2156-2165) and the pVL series (Lucklow et al., *Virology* (1989) 170:31-39).

In yet another embodiment, the nucleic acids described herein can be expressed in mammalian cells using a mammalian expression vector. Examples of mammalian expression vectors include pCDM8 (Seed, *Nature* (1987) 329:840) and pMT2PC (Kaufman et al., *EMBO J.* (1987) 6:187-195). When used in mammalian cells, the expression vector's control functions can be provided by viral regulatory elements. For example, commonly used promoters are derived from polyoma, Adenovirus 2, cytomegalovirus, and Simian Virus 40. Other suitable expression systems for both prokaryotic and eukaryotic cells are described in chapters 16 and 17 of Sambrook et al., eds., Molecular Cloning: A Laboratory Manual. 2nd, ed., Cold Spring Harbor Laboratory, Cold Spring Harbor Laboratory Press, Cold Spring Harbor, N.Y., 1989.

Vectors can be introduced into prokaryotic or eukaryotic cells via conventional transformation or transfection techniques. As used herein, the terms "transformation" and "transfection" refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in, for example, Sambrook et al. (supra).

For stable transformation of bacterial cells, it is known that, depending upon the expression vector and transformation technique used, only a small fraction of cells will take-up and replicate the expression vector. In order to identify and select these transformants, a gene that encodes a selectable marker (e.g., resistance to antibiotics) can be introduced into the host cells along with the gene of interest. Selectable markers include those that confer resistance to drugs, such as ampicillin, kanamycin, chloramphenicol, or tetracycline. Nucleic acids encoding a selectable marker can be introduced into a host cell on the same vector as that encoding a polypeptide described herein or can be introduced on a separate vector. Cells stably transfected with the introduced nucleic acid can be identified by drug selection (e.g., cells that have incorporated the selectable marker gene will survive, while the other cells die).

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) can be introduced into the host cells along with the gene of interest. Preferred selectable markers include those which confer resistance to drugs, such as G418, hygromycin, and methotrexate. Nucleic acids encoding a selectable marker can be introduced into a host cell on the same vector as that encoding a polypeptide described herein or can be introduced on a separate vector. Cells stably transfected with the introduced nucleic acid can be identified by drug selection (e.g., cells that have incorporated the selectable marker gene will survive, while the other cells die).

Transport Proteins

Transport proteins can export polypeptides and organic compounds (e.g., fatty alcohols) out of a host cell. Many transport and efflux proteins serve to excrete a wide variety of compounds and can be naturally modified to be selective for particular types of hydrocarbons.

Non-limiting examples of suitable transport proteins are ATP-Binding Cassette (ABC) transport proteins, efflux proteins, and fatty acid transporter proteins (FATP). Additional non-limiting examples of suitable transport proteins include the ABC transport proteins from organisms such as *Caenorhabditis elegans, Arabidopsis thalania, Alkaligenes eutrophus*, and *Rhodococcus erythropolis*. Exemplary ABC transport proteins that can be used are listed in FIG. 9 (e.g., CER5, AtMRP5, AmiS2, and AtPGP1). Host cells can also be chosen for their endogenous ability to secrete organic compounds. The efficiency of organic compound production and secretion into the host cell environment (e.g., culture medium, fermentation broth) can be expressed as a ratio of intracellular product to extracellular product. In some examples, the ratio can be about 5:1, 4:1, 3:1, 2:1, 1:1, 1:2, 1:3, 1:4, or 1:5.

Fermentation

The production and isolation of fatty alcohols can be enhanced by employing beneficial fermentation techniques. One method for maximizing production while reducing costs is increasing the percentage of the carbon source that is converted to hydrocarbon products.

During normal cellular lifecycles, carbon is used in cellular functions, such as producing lipids, saccharides, proteins, organic acids, and nucleic acids. Reducing the amount of carbon necessary for growth-related activities can increase the efficiency of carbon source conversion to product. This can be achieved by, for example, first growing host cells to a desired density (for example, a density achieved at the peak of the log phase of growth). At such a point, replication checkpoint genes can be harnessed to stop the growth of cells. Specifically, quorum sensing mechanisms (reviewed in Camilli et al., *Science* 311:1113, 2006; Venturi *FEMS Microbio. Rev.* 30:274-291, 2006; and Reading et al., *FEMS Microbiol. Lett.* 254:1-11, 2006) can be used to activate checkpoint genes, such as p53, p21, or other checkpoint genes.

Genes that can be activated to stop cell replication and growth in *E. coli* include umuDC genes. The overexpression of umuDC genes stops the progression from stationary phase to exponential growth (Murli et al., *J. of Bact.* 182:1127, 2000). UmuC is a DNA polymerase that can carry out translesion synthesis over non-coding lesions—the mechanistic basis of most UV and chemical mutagenesis. The umuDC gene products are involved in the process of translesion synthesis and also serve as a DNA sequence damage checkpoint. The umuDC gene products include UmuC, UmuD, umuD', UmuD'$_2$C, UmuD'$_2$, and UmuD$_2$. Simultaneously, product-producing genes can be activated, thus minimizing the need for replication and maintenance pathways to be used while a fatty aldehyde is being made. Host cells can also be engineered to express umuC and umuD from *E. coli* in pBAD24 under the prpBCDE promoter system through de novo synthesis of this gene with the appropriate end-product production genes.

The percentage of input carbons converted to fatty alcohols can be a cost driver. The more efficient the process is (i.e., the higher the percentage of input carbons converted to fatty alcohols), the less expensive the process will be. For oxygen-containing carbon sources (e.g., glucose and other carbohydrate based sources), the oxygen must be released in the form of carbon dioxide. For every 2 oxygen atoms released, a carbon atom is also released leading to a maximal theoretical metabolic efficiency of approximately 34% (w/w) (for fatty acid derived products). This figure, however, changes for other organic compounds and carbon sources. Typical efficiencies in the literature are approximately less than 5%. Host cells engineered to produce fatty alcohols can have greater than about 1, 3, 5, 10, 15, 20, 25, and 30% efficiency. In one example, host cells can exhibit an efficiency of about 10% to about 25%. In other examples, such host cells can exhibit an efficiency of about 25% to about 30%. In other examples, host cells can exhibit greater than 30% efficiency.

The host cell can be additionally engineered to express recombinant cellulosomes, such as those described in PCT application number PCT/US2007/003736. These cellulosomes can allow the host cell to use cellulosic material as a carbon source. For example, the host cell can be additionally engineered to express invertases (EC 3.2.1.26) so that sucrose can be used as a carbon source. Similarly, the host cell can be engineered using the teachings described in U.S. Pat. Nos. 5,000,000; 5,028,539; 5,424,202; 5,482,846; and 5,602,030; so that the host cell can assimilate carbon efficiently and use cellulosic materials as carbon sources.

In one example, the fermentation chamber can enclose a fermentation that is undergoing a continuous reduction. In this instance, a stable reductive environment can be created. The electron balance can be maintained by the release of carbon dioxide (in gaseous form). Efforts to augment the NAD/H and NADP/H balance can also facilitate in stabilizing the electron balance. The availability of intracellular NADPH can also be enhanced by engineering the host cell to express an NADH:NADPH transhydrogenase. The expression of one or more NADH:NADPH transhydrogenases converts the NADH produced in glycolysis to NADPH, which can enhance the production of fatty alcohols.

For small scale production, the engineered host cells can be grown in batches of, for example, about 100 mL, 500 mL, 1 L, 2 L, 5 L, or 10 L; fermented; and induced to express desired fatty aldehyde biosynthetic genes and/or an alcohol dehydrogenase genes based on the specific genes encoded in the appropriate plasmids. For large scale production, the engineered host cells can be grown in batches of about 10 L, 100 L, 1000 L, 10,000 L, 100,000 L, 1,000,000 L or larger; fermented; and induced to express desired fatty aldehyde biosynthetic genes and/or alcohol dehydrogenase genes based on the specific genes encoded in the appropriate plasmids or incorporated into the host cell's genome.

For example, a suitable production host, such as *E. coli* cells, harboring plasmids containing the desired genes or having the genes integrated in its chromosome can be incubated in a suitable reactor, for example a 1 L reactor, for 20 hours at 37° C. in M9 medium supplemented with 2% glucose, carbenicillin, and chloramphenicol. When the $OD_{600}$ of the culture reaches 0.9, the production host can be induced with IPTG alcohol After incubation, the spent media can be extracted and the organic phase can be examined for the presence of fatty alcohols using GC-MS.

In some instances, after the first hour of induction, aliquots of no more than about 10% of the total cell volume can be removed each hour and allowed to sit without agitation to allow the fatty alcohols to rise to the surface and undergo a spontaneous phase separation or precipitation. The fatty alcohol component can then be collected, and the aqueous phase returned to the reaction chamber. The reaction chamber can be operated continuously. When the $OD_{600}$ drops below 0.6, the cells can be replaced with a new batch grown from a seed culture.

Producing Fatty Alcohols Using Cell-Free Methods

In some methods described herein, a fatty alcohol can be produced using a purified polypeptide (e.g., a fatty alcohol biosynthetic polypeptide) described herein and a substrate (e.g., fatty aldehyde), produced, for example, by a method described herein. For example, a host cell can be engineered to express a fatty alcohol biosynthetic polypeptide or variant as described herein. The host cell can be cultured under conditions suitable to allow expression of the polypeptide. Cell free extracts can then be generated using known methods. For example, the host cells can be lysed using detergents or by sonication. The expressed polypeptides can be purified using known methods. After obtaining the cell free extracts, substrates described herein can be added to the cell free extracts and maintained under conditions to allow conversion of the substrates (e.g., fatty aldehydes) to fatty alcohols. The fatty alcohols can then be separated and purified using known techniques.

In some instances, a fatty aldehyde described herein can be converted into a fatty alcohol by contacting the fatty aldehyde with a fatty alcohol biosynthetic polypeptide listed in FIG. 10, or a variant thereof.

Post-Production Processing

The fatty alcohols produced during fermentation can be separated from the fermentation media. Any known technique for separating fatty alcohols from aqueous media can be used. One exemplary separation process is a two phase (bi-phasic) separation process. This process involves fermenting the genetically engineered host cells under conditions sufficient to produce a fatty alcohols, allowing the fatty alcohol to collect in an organic phase, and separating the organic phase from the aqueous fermentation broth. This method can be practiced in both a batch and continuous fermentation processes.

Bi-phasic separation uses the relative immiscibility of fatty alcohols to facilitate separation. Immiscible refers to the relative inability of a compound to dissolve in water and is defined by the compound's partition coefficient. One of ordinary skill in the art will appreciate that by choosing a fermentation broth and organic phase, such that the fatty alcohol being produced has a high log P value, the fatty alcohol can separate into the organic phase, even at very low concentrations, in the fermentation vessel.

The fatty alcohols produced by the methods described herein can be relatively immiscible in the fermentation broth, as well as in the cytoplasm. Therefore, the fatty alcohol can collect in an organic phase either intracellularly or extracellularly. The collection of the products in the organic phase can lessen the impact of the fatty alcohol on cellular function and can allow the host cell to produce more product.

The methods described herein can result in the production of homogeneous compounds wherein at least about 60%, 70%, 80%, 90%, or 95% of the fatty alcohols produced will have carbon chain lengths that vary by less than about 6 carbons, less than about 4 carbons, or less than about 2 carbons. These compounds can also be produced with a relatively uniform degree of saturation. These compounds can be used directly as fuels, fuel additives, starting materials for production of other chemical compounds (e.g., polymers, surfactants, plastics, textiles, solvents, adhesives, etc.), or personal care additives. These compounds can also be used as feedstock for subsequent reactions, for example, hydrogenation, catalytic cracking (e.g., via hydrogenation, pyrolisis, or both), to make other products.

In some embodiments, the fatty alcohols produced using methods described herein can contain between about 50% and about 90% carbon; or between about 5% and about 25% hydrogen. In other embodiments, the fatty alcohols produced using methods described herein can contain between about 65% and about 85% carbon; or between about 10% and about 15% hydrogen.

Surfactant and Detergent Compositions and Bioproducts

The fatty alcohols described herein can be used as or converted into a surfactant or detergent composition. One of ordinary skill in the art will appreciate that, depending upon the intended purpose of the surfactant or detergent, different fatty alcohols can be produced and used. For example, when the fatty alcohols described herein are used as a feedstock for surfactant or detergent production, one of ordinary skill in the art will appreciate that the characteristics of the fatty alcohol feedstock will affect the characteristics of the surfactant or detergent produced. Hence, the characteristics of the surfactant or detergent product can be selected for by producing particular fatty alcohols for use as a feedstock.

Bioproducts (e.g., fatty alcohols) comprising biologically produced organic compounds, particularly fatty alcohols biologically produced using the fatty acid biosynthetic pathway, have not been produced from renewable sources and, as such, are new compositions of matter. These new bioproducts can be distinguished from organic compounds derived from petrochemical carbon on the basis of dual carbon-isotopic fingerprinting or $^{14}C$ dating. Additionally, the specific source of biosourced carbon (e.g., glucose vs. glycerol) can be determined by dual carbon-isotopic fingerprinting (see, e.g., U.S. Pat. No. 7,169,588, which is herein incorporated by reference).

The ability to distinguish bioproducts from petroleum based organic compounds is beneficial in tracking these materials in commerce. For example, organic compounds or chemicals comprising both biologically based and petroleum based carbon isotope profiles may be distinguished from organic compounds and chemicals made only of petroleum based materials. Hence, the instant materials may be followed in commerce on the basis of their unique carbon isotope profile.

Bioproducts can be distinguished from petroleum based organic compounds by comparing the stable carbon isotope ratio ($^{13}C/^{12}C$) in each fuel. The $^{13}C/^{12}C$ ratio in a given bioproduct is a consequence of the $^{13}C/^{12}C$ ratio in atmospheric carbon dioxide at the time the carbon dioxide is fixed. It also reflects the precise metabolic pathway. Regional variations also occur. Petroleum, $C_3$ plants (the broadleaf), $C_4$ plants (the grasses), and marine carbonates all show significant differences in $^{13}C/^{12}C$ and the corresponding $\delta^{13}C$ values. Furthermore, lipid matter of $C_3$ and $C_4$ plants analyze differently than materials derived from the carbohydrate components of the same plants as a consequence of the metabolic pathway.

Within the precision of measurement, $^{13}C$ shows large variations due to isotopic fractionation effects, the most significant of which for bioproducts is the photosynthetic mechanism. The major cause of differences in the carbon isotope ratio in plants is closely associated with differences in the pathway of photosynthetic carbon metabolism in the plants, particularly the reaction occurring during the primary carboxylation (i.e., the initial fixation of atmospheric $CO_2$). Two large classes of vegetation are those that incorporate the "$C_3$" (or Calvin-Benson) photosynthetic cycle and those that incorporate the "$C_4$" (or Hatch-Slack) photosynthetic cycle.

In $C_3$ plants, the primary $CO_2$ fixation or carboxylation reaction involves the enzyme ribulose-1,5-diphosphate carboxylase, and the first stable product is a 3-carbon compound. $C_3$ plants, such as hardwoods and conifers, are dominant in the temperate climate zones.

In $C_4$ plants, an additional carboxylation reaction involving another enzyme, phosphoenol-pyruvate carboxylase, is the primary carboxylation reaction. The first stable carbon compound is a 4-carbon acid that is subsequently decarboxylated. The $CO_2$ thus released is refixed by the $C_3$ cycle. Examples of $C_4$ plants are tropical grasses, corn, and sugar cane.

Both $C_4$ and $C_3$ plants exhibit a range of $^{13}C/^{12}C$ isotopic ratios, but typical values are about −7 to about −13 per mil for $C_4$ plants and about −19 to about −27 per mil for $C_3$ plants (see, e.g., Stuiver et al., *Radiocarbon* 19:355, 1977). Coal and petroleum fall generally in this latter range. The $^{13}C$ measurement scale was originally defined by a zero set by Pee Dee Belemnite (PDB) limestone, where values are given in parts per thousand deviations from this material. The "$\delta^{13}C$" values are expressed in parts per thousand (per mil), abbreviated, ‰, and are calculated as follows:

$$\delta^{13}C(‰)=[(^{13}C/^{12}C)_{sample}-(^{13}C/^{12}C)_{standard}]/(^{13}C/^{12}C)_{standard}\times 1000$$

Since the PDB reference material (RM) has been exhausted, a series of alternative RMs have been developed in cooperation with the IAEA, USGS, NIST, and other selected international isotope laboratories. Notations for the per mil deviations from PDB is $\delta^{13}C$. Measurements are made on $CO_2$ by high precision stable ratio mass spectrometry (IRMS) on molecular ions of masses 44, 45, and 46.

The compositions described herein include bioproducts produced by any of the methods described herein. Specifically, the bioproduct can have a $\delta^{13}C$ of about −28 or greater, about −27 or greater, −20 or greater, −18 or greater, −15 or greater, −13 or greater, −10 or greater, or −8 or greater. For example, the bioproduct can have a $\delta^{13}C$ of about −30 to about −15, about −27 to about −19, about −25 to about −21, about −15 to about −5, about −13 to about −7, or about −13 to about −10. In other instances, the bioproduct can have a $\delta^{13}C$ of about −10, −11, −12, or −12.3.

Bioproducts can also be distinguished from petroleum based organic compounds by comparing the amount of $^{14}C$ in each compound. Because $^{14}C$ has a nuclear half life of 5730 years, petroleum based fuels containing "older" carbon can be distinguished from bioproducts which contain "newer" carbon (see, e.g., Currie, "Source Apportionment of Atmospheric Particles", *Characterization of Environmental Particles*, J. Buffle and H. P. van Leeuwen, Eds., 1 of Vol. I of the IUPAC Environmental Analytical Chemistry Series (Lewis Publishers, Inc) (1992) 3-74).

The basic assumption in radiocarbon dating is that the constancy of $^{14}C$ concentration in the atmosphere leads to the constancy of $^{14}C$ in living organisms. However, because of atmospheric nuclear testing since 1950 and the burning of fossil fuel since 1850, $^{14}C$ has acquired a second, geochemical time characteristic. Its concentration in atmospheric $CO_2$, and hence in the living biosphere, approximately doubled at the peak of nuclear testing, in the mid-1960s. It has since been gradually returning to the steady-state cosmogenic (atmospheric) baseline isotope rate ($^{14}C/^{12}C$) of about $1.2\times10^{-12}$, with an approximate relaxation "half-life" of 7-10 years. (This latter half-life must not be taken literally; rather, one must use the detailed atmospheric nuclear input/decay function to trace the variation of atmospheric and biospheric $^{14}C$ since the onset of the nuclear age.)

It is this latter biospheric $^{14}C$ time characteristic that holds out the promise of annual dating of recent biospheric carbon. $^{14}C$ can be measured by accelerator mass spectrometry (AMS), with results given in units of "fraction of modern carbon" ($f_M$). $f_M$ is defined by National Institute of Standards and Technology (NIST) Standard Reference Materials (SRMs) 4990B and 4990C. As used herein, "fraction of modern carbon" or "$f_M$" has the same meaning as defined by National Institute of Standards and Technology (NIST) Standard Reference Materials (SRMs) 4990B and 4990C, known as oxalic acids standards HOxI and HOxII, respectively. The fundamental definition relates to 0.95 times the $^{14}C/^{12}C$ isotope ratio HOxI (referenced to AD 1950). This is roughly equivalent to decay-corrected pre-Industrial Revolution wood. For the current living biosphere (plant material), $f_M$ is approximately 1.1.

The compositions described herein include bioproducts that can have an $f_M$ $^{14}C$ of at least about 1. For example, the bioproduct can have an $f_M$ $^{14}C$ of at least about 1.01, an $f_M$ $^{14}C$ of about 1 to about 1.5, an $f_M$ $^{14}C$ of about 1.04 to about 1.18, or an $f_M$ $^{14}C$ of about 1.111 to about 1.124.

Another measurement of $^{14}C$ is known as the percent of modern carbon, pMC. For an archaeologist or geologist using $^{14}C$ dates, AD 1950 equals "zero years old". This also represents 100 pMC. "Bomb carbon" in the atmosphere reached almost twice the normal level in 1963 at the peak of thermonuclear weapons. Its distribution within the atmosphere has been approximated since its appearance, showing values that are greater than 100 pMC for plants and animals living since AD 1950. It has gradually decreased over time with today's value being near 107.5 pMC. This means that a fresh biomass material, such as corn, would give a $^{14}C$ signature near 107.5 pMC. Petroleum based compounds will have a pMC value of zero. Combining fossil carbon with present day carbon will result in a dilution of the present day pMC content. By presuming 107.5 pMC represents the $^{14}C$ content of present day biomass materials and 0 pMC represents the $^{14}C$ content of petroleum based products, the measured pMC value for that material will reflect the proportions of the two component types. For example, a material derived 100% from present day soybeans would give a radiocarbon signature near 107.5 pMC. If that material was diluted 50% with petroleum based products, it would give a radiocarbon signature of approximately 54 pMC.

A biologically based carbon content is derived by assigning "100%" equal to 107.5 pMC and "0%" equal to 0 pMC. For example, a sample measuring 99 pMC will give an equivalent biologically based carbon content of 93%. This value is referred to as the mean biologically based carbon result and assumes all the components within the analyzed material originated either from present day biological material or petroleum based material.

A bioproduct described herein can have a pMC of at least about 50, 60, 70, 75, 80, 85, 90, 95, 96, 97, 98, 99, or 100. In other instances, a bioproduct described herein can have a pMC of between about 50 and about 100; about 60 and about 100; about 70 and about 100; about 80 and about 100; about 85 and about 100; about 87 and about 98; or about 90 and about 95. In yet other instances, a bioproduct described herein can have a pMC of about 90, 91, 92, 93, 94, or 94.2.

Fuel additives are used to enhance the performance of a fuel or engine. For example, fuel additives can be used to alter the freezing/gelling point, cloud point, lubricity, viscosity, oxidative stability, ignition quality, octane level, and/or flash point. In the United States, all fuel additives must be registered with Environmental Protection Agency. The names of fuel additives and the companies that sell the fuel additives are publicly available by contacting the EPA or by viewing the agency's website. One of ordinary skill in the art will appreciate that the fatty alcohol-based biofuels described herein can be mixed with one or more fuel additives to impart a desired quality.

The fatty alcohol-based surfactants and/or detergents described herein can be mixed with other surfactants and/or detergents well known in the art.

In some examples, the mixture can include at least about 10%, 15%, 20%, 30%, 40%, 50%, or 60% by weight of the fatty alcohol. In other examples, a surfactant or detergent composition can be made that includes at least about 5%, 10%, 20%, 30%, 40%, 50%, 60%, 70%, 80%, 85%, 90% or 95% of a fatty alcohol that includes a carbon chain that is 8, 10, 12, 13, 14, 15, 16, 17, 18, 19, 20, 21 or 22 carbons in length. Such surfactant or detergent compositions can additionally include at least one additive selected from a surfactant; a microemulsion; at least about 5%, 10%, 15%, 20%, 30%, 40%, 50%, 60%, 70%, 80%, 85%, 90%, or 95% of surfactant or detergent from nonmicrobial sources such as plant oils or petroleum.

The invention is further illustrated by the following examples. The examples are provided for illustrative purposes only. They are not to be construed as limiting the scope or content of the invention in any way.

EXAMPLES

Example 1

Identification of Carboxylic Acid Reductase (CAR) Homologs

The carboxylic acid reductase (CAR) from *Nocardia* sp. strain NRRL 5646 can reduce carboxylic acids (e.g., fatty acids) into their corresponding aldehydes without utilizing separate activating enzymes, such as acyl-CoA synthases (Li et al., *J. Bacteriol.* 179:3482-3487, 1997; He et al., *Appl. Environ. Microbiol.* 70:1874-1881, 2004)).

A BLAST search using the NRRL 5646 CAR amino acid sequence (Genpept accession AAR91681) (SEQ ID NO:16) as the query sequence identified approximately 20 homologous sequences. Three homologs, listed in Table 7, were evaluated for their ability to convert fatty acids into fatty aldehydes in vivo when expressed in *E. coli*.

At the nucleotide sequence level, carA (SEQ ID NO:19), carB (SEQ ID NO:21), and fadD9 (SEQ ID NO:17) demonstrated 62.6%, 49.4%, and 60.5% homology, respectively, to the car gene (AY495697) of *Nocardia* sp. NRRL 5646 (SEQ ID NO:15). At the amino acid level, CARA (SEQ ID NO:20), CARB (SEQ ID NO:22), and FadD9 (SEQ ID NO:18) demonstrated 62.4%, 59.1% and 60.7% identity, respectively, to CAR of *Nocardia* sp. NRRL 5646 (SEQ ID NO:16).

TABLE 7

CAR-like Protein and the corresponding coding sequences.

| Genpept accession | Locus_tag | Annotation in GenBank | Gene name |
|---|---|---|---|
| NP_217106 | Rv 2590 | Probable fatty-acid-CoA ligase (FadD9) | fadD9 |
| ABK75684 | MSMEG 2956 | NAD dependent epimerase/dehydratase family protein | carA |
| YP_889972.1 | MSMEG 5739 | NAD dependent epimerase/dehydratase family protein | carB |

Example 2

Identification of Alcohol Dehydrogenase Genes

Reverse Engineering

E. coli contains at least one enzyme that catalyzes the reversible oxidoreduction of fatty aldehydes and fatty alcohols (i.e. fatty aldehyde reductase/alcohol dehydrogenase). Reverse engineering was used to identify such fatty aldehyde reducatases/fatty alcohol dehydrogenses in E. coli MG1655 cells expressing the acyl-ACP reductase YP_400611 from Synechococcus elongatus (Synpcc7942_1594) (SEQ ID NO:196). Four 3 mL LB cultures were grown overnight at 37° C., and 55 µL of stationary phase cultures were used to inoculate four independent 5.5 mL of LB. Those 5.5 mL cultures were then grown to an $OD_{600}$ of 0.8-1.0 and were then used to inoculate a corresponding number of 2 L baffled shakeflasks, each with 500 mL Hu-9 minimal media. 20 hrs after induction the cells were pelleted at 4,000×g for 20 min. The cell pellet was resuspended in 30 mL of 100 mM phosphate buffer at pH 7.2 with 1× Bacterial Protease Arrest (G Biosciences). The cells were lysed in a french press at 15,000 psi with two passes through the instrument. The cell debris was then removed by centrifuging at 10,000×g for 20 mins. The cell lysate was loaded onto two HiTrapQ columns (GE Healthcare) connected in series. The following buffers were used to elute proteins: (A) 50 mM Tris, pH 7.5 and (B) 50 mM Tris, pH 7.5 with 1 M NaCl. A gradient from 0% B to 100% B was run over 5 column volumes at a flow rate of 3 mL/min while 4 mL fractions were collected.

The fractions were assayed for alcohol dehydrogenase activity by taking 190 µL of a protein fraction and adding 5 µL of a 20 mM NADPH (Sigma) solution and 5 µL of a 20 mM dodecanal (Fluka) solution in DMSO. The reactions were incubated at 37° C. for 1 hr. They were then extracted with 100 µL of ethyl acetate and analyzed for dodecanol via GC/MS. Fractions eluting around 350 mM NaCl contained alcohol dehydrogenase activity.

Fractions containing alcohol dehydrogenase activity were pooled and loaded onto a 1 mL ResourceQ column (GE Healthcare). The same conditions used for the HiTrapQ column were used, except 0.5 mL fractions were collected. Protein fractions demonstrating alcohol dehydrogenase activity were then pooled and concentrated using Amicon (Milipore) protein concentrators (10,000 kDa cutoffs) to a volume of 1 mL. The solution was then loaded onto a HiPrep 200 size exclusion column (GE Healthcare). A buffer solution containing 50 mM Tris, pH 7.5, and 150 mM NaCl was run through the column at a rate of 0.3 mL per min. 2 mL fractions were collected. Two protein fractions contained alcohol dehydrogenase activity. These two fractions, plus fractions before and after these two fractions, were loaded onto a polyacrylamide gel and stained with SimplySafe Commassie stain (Invitrogen).

Comparing the bands in the active and inactive fractions, one protein band appeared in the active fractions that was not seen in the inactive fraction. This protein band was cut from gel and submitted to the Stanford Mass Spectroscopy Facility for LC/MS/MS protein sequencing. One of the proteins identified in this analysis was YahK.

To verify that YahK was indeed an alcohol dehydrogenase, yahK was knocked out in E. coli MG1655(DE3, ΔfadD, ΔyjgB) (control strain) (described in Example 4). The yahK knock-out strain MG1655(DE3, ΔfadD, Δyjg, BΔyahK) was constructed using the lamda red system (described in Example 4) with the following primers:

yahK_F (SEQ ID NO: 197)
(CATATCAGGCGTTGCCAAATACACATAGCTAATCAGGAGTAAACACAA

TG)
and yahK_R (SEQ ID NO: 198)
(AATCGCACACTAACAGACTGAAAAAATTAATAAATACCCTGTGGTTTA

AC).

This ΔyahK strain and the control strain, both expressing the acyl-ACP reductase YP_400611, were cultured under conditions described above. Cell free lysates were made from both strains, and each lysate was assayed for alcohol dehydrogenase activity as discussed above.

The ΔyahK strain did not convert dodecanal to dodecanol, while the wild type strain had this activity. For additional verification, each lysate was run on a HiTrapQ column as described above. The wild type lysate had alcohol dehydrogenase activity in fractions eluting around 350 mM NaCl, while the ΔyahK lysate had no alcohol dehydrogenase activity in this region.

Bioinformatics

It was reasoned that possible alcohol dehydrogenases in E. coli were members of four protein families: Zn-dependent alcohol dehydrogenases (Pfam 00107 and 08240), Fe-dependent alcohol dehydrogenases (Pfam 00465), aldo-keto reductases (Pfam 00248) and short-chain dehydrogenases (Pfam 00106) (Pfam=protein family according to "pfam.sanger.ac.uk"). Using the Pfam motifs, all members of these four protein families in E. coli were identified (listed in FIG. 10). From this list, the following 8 candidates were chosen for experimental analysis: yahK, yjgB, adhP, dkgA, dkgB, yhdH, ydjL, and yqhD.

To determine if these genes could reduce fatty aldehydes to fatty alcohols, these 8 genes were cloned into a pET-Duet vector along with E. coli 'tesA. These genes were then transformed into E. coli (DE3) MG1655 ΔyjgBΔTyahK cells. Next 3 mL overnight starter cultures were grown in LB with carbanecillin (100 mg/L) at 37° C. A control strain lacking a candidate alcohol dehydrogenase was also included in the experiment. 1 mL of each overnight culture was used to inoculate 50 mL of fresh LB with carbanecillin. The cultures were shaken at 37° C. until reaching an $OD_{600}$ of 0.8-1. The cultures were then transferred to 18° C., induced with 1 mM IPTG, and shaken overnight.

Cell free lysates were prepared by centrifuging the cultures at 4,000×g for 20 mins. The cultures were then resuspended in 1 mL of Bugbuster (Novagen) and gently shaken at room temperature for 5 min. The cell debris was removed by spinning at 15,000×g for 10 min. The resulting lysates were assayed for alcohol dehydrogenase activity by mixing 88 μL of lysate, 2 μL of 40 mM cis-11-hexadecenal in DMSO, and 10 μL of 20 mM NADPH. The samples were incubated at 37° C. for 30 min. and were then extracted with 100 μL of ethyl acetate. The extracts were analyzed using GC/MS.

All proteins showed significantly better conversion of cis-11-hexadecenal to cis-11-hexadecanol as compared with the 'TesA only control (see Table 8). These results were confirmed in assays using dodecanal instead of cis-11-hexadecenal as the substrate (see Table 8).

Figure 11:
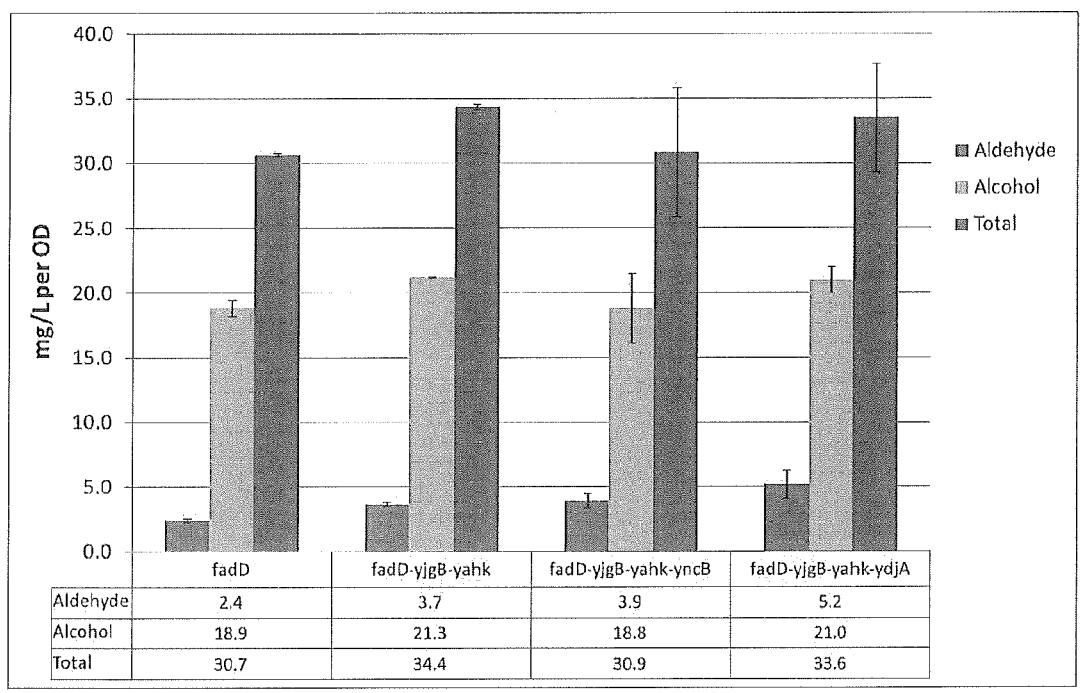
FIG. 11 is a graphic representation of fatty alcohol production in various deletion mutants of *E. coli*.

To investigate how these enzymes contribute to fatty alcohol dehydrogenase activity in E. coli under production conditions, first the yjgB yahK double knock-out strain in MG1655(DE3, ΔfadD) (described above) was tested by transforming it with a plasmid expressing acyl-ACP reductase YP_400611 and analyzing fatty aldehyde and fatty alcohol titers. The test strain also contained a plasmid expressing a decarbonylase. This double knock-out mutant showed slightly higher fatty aldehyde titers in several experiments (see, e.g., FIG. 11), confirming that these two putative alcohol dehydrogenases contribute to fatty alcohol dehydrogenase activity in E. coli under production conditions (see also Example 4 for similar results from a MG1655(DE3, ΔfadD ΔyjgB) strain). Next, two additional genes, yncB and ydjA, were deleted in the yjgB yahK double mutant. YdjA, which is not a member of the four protein families mentioned above, demonstrated slightly elevated fatty aldehyde levels (see FIG. 11), indicating that it may also contribute to fatty alcohol dehydrogenase activity in E. coli under production conditions.

Figure 12:
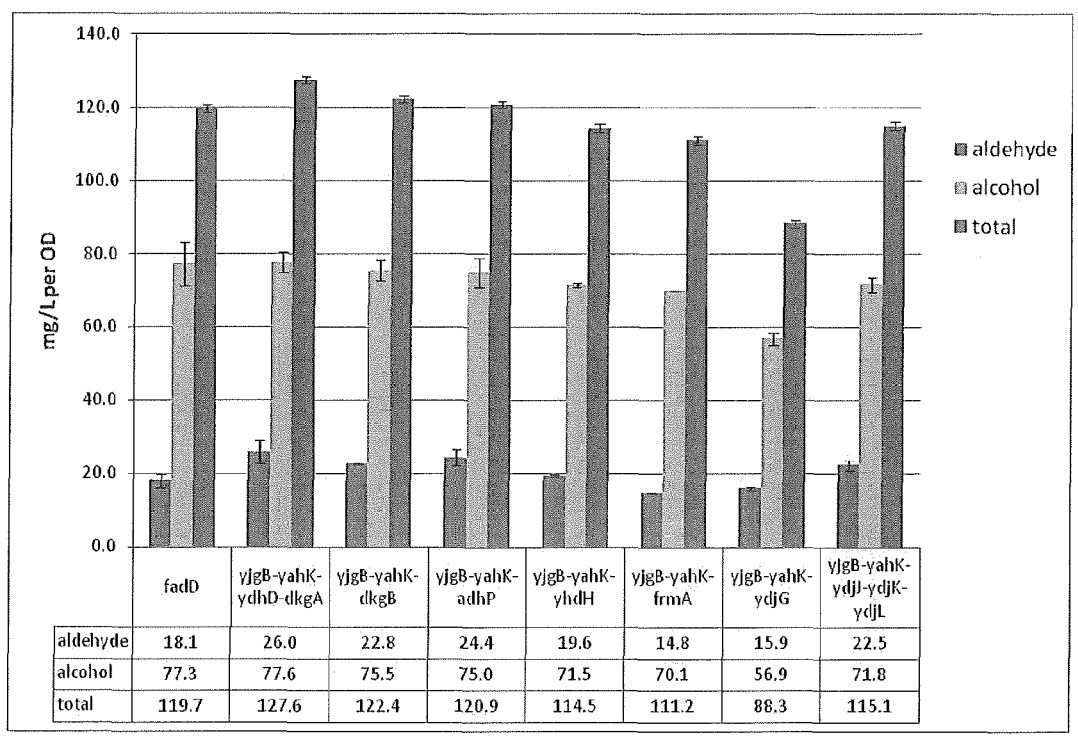
FIG. 12 is a graphic representation of fatty alcohol production in various deletion mutants of *E. coli*.

Additionally, the active fatty alcohol dehydrogenases from Table 8 were also deleted in MG1655 (DE3, ΔfadD, Δyjg, B ΔyahK) and tested as described above. Several of these deletion strains showed slightly elevated fatty aldehyde levels, suggesting that these may also contribute to fatty alcohol dehydrogenase activity in E. coli under production conditions (see FIG. 12).

TABLE 8

Overexpression of putative fatty alcohol dehydrogenase genes

| | GC/MS Assay % conversion to corresponding alcohol | | NADPH assay initial rate (slope) |
|---|---|---|---|
| substrate | dodecanal | cis 11-hexadecenal | cis 11-hexadecenal |
| Overexpression: | | | |
| none | 9 | 12 | 0.2 |
| YjgB | 54 | 89 | 24.8 |
| YahK | 47 | 87 | 28.3 |
| AdhP | 52 | 45 | 4.1 |
| YdjL | 51 | 23 | 0.14 |
| YhdH | 59 | 74 | 13.7 |
| YqhD | 55 | 23 | 7.3 |
| yafB (dkgB) | 52 | 65 | 9.4 |
| YqhE (dkgA) | 45 | 50 | 9.6 |

Example 3

Expression of CAR Homologs and Alcohol Dehydrogenase in E. coli

A. CAR Plasmid Construction

Three E. coli expression plasmids were constructed to express the genes encoding the CAR homologs listed in Table 7. First, fadD9 was amplified from genomic DNA of Mycobacterium tuberculosis H37Rv (obtained from The University of British Columbia, and Vancouver, BC Canada) using the primers fadD9F and FadDR (see Table 9). The PCR product was first cloned into PCR-blunt (Invitrogen) and then released as an NdeI-AvrII fragment. The NdeI-AvrII fragment was then cloned between the NdeI and AvrII sites of pACYCDuet-1 (Novogen) to generate pACYCDuet-1-fadD9.

The carA gene was amplified from the genomic DNA of Mycobacterium smegmatis MC2 155 (obtained from the ATCC (ATCC 23037D-5)) using primers CARMCaF and CARMCaR (see Table 9). The carB gene was amplified from the genomic DNA of Mycobacterium smegmatis MC2 155 (obtained from the ATCC (ATCC 23037D-5)) using primers CARMCbF and CARMCbR (see Table 9). Each PCR product was first cloned into PCR-blunt and then released as an NdeI-AvrII fragment. Each of the two fragments was then subcloned between the NdeI and AvrII sites of pACYCDuet-1 (Novogen) to generate pACYCDuet-1-carA and pACYCDuet-1-carB.

TABLE 9

Primers used to amplify genes encoding CAR homologs

| | |
|---|---|
| fadD9F | cat ATGTCGATCAACGATCAGCGACTGAC (SEQ ID NO: 1) |
| fadD9R | cctagg TCACAGCAGCCCGAGCAGTC (SEQ ID NO: 2) |
| CARMCaF | cat ATGACGATCGAAACGCG (SEQ ID NO: 3) |
| CARMCaR | cctagg TTACAGCAATCCGAGCATCT (SEQ ID NO: 4) |
| CARMCbF | cat ATGACCAGCGATGTTCAC (SEQ ID NO: 5) |
| CARMCbR | cctagg TCAGATCAGACCGAACTCACG (SEQ ID NO: 6) |

B. Alcohol Dehydrogenase Plasmid Construction

The plasmid pETDuet-1-'tesA-yjgB carries 'tesA and yjgB (a putative alcohol dehydrogenase; GenBank accession number, NP_418690; GenPept accession number AAC77226) from the E. coli K12 strain.

The gene yjgB (GenBank accession number, NP_418690) was amplified from the genomic DNA of E. coli K-12 using the following primers.

The yjgB insert was generated by PCR using the following primers:

```
NcoI YjgB forward:
                                 (SEQ ID NO: 199)
aatccTGGCATCGATGATAAAAAGCTATGCCGCAAAAG HindIII YjgB reverse:
                                 (SEQ ID NO: 200)
ataaaagctTTCAAAAATCGGCTTTCAACACCACGCGG
```

The PCR product was then subcloned into the NcoI and HindIII sites of pETDuet-1-'tesA to generate pETDuet-1-'tesA-yjgB.

The plasmid pETDuet-1-'tesA-alrAadp1 carries 'tesA and alrAadp1 (GenPept accession number CAG70248.1) from *Acinetobacter baylyi* ADP1.

The gene alrAadp1 was amplified from the genomic DNA of *Acinetobacter baylyi* ADP1 by a two-step PCR procedure. The first set of PCR reactions eliminated an internal NcoI site at by 632-636 with the following primer pairs:

```
ADP1 Alr mut1 reverse:
                                    (SEQ ID NO: 201)
5'-GACCACGTGATCGGCCCCCATAGCTTTGAGCTCATC ADP1 Alr1 mut1 forward:
                                    (SEQ ID NO: 202)
5'-GATGAGCTCAAAGCTATGGGGGCCGATCACGTGGTC
```

The PCR products were then isolated, purified using the Qiagen gel extraction kit, and used as inputs for a second PCR reaction with the following primers to produce full-length AlrAadp1 with a C→T mutation at position 633:

```
NcoI ADP1 Alr1 forward:
                                    (SEQ ID NO: 203)
5'-AATACCATGGCAACAACTAATGTGATTCATGCTTATGCTGCA HindIII ADP1 Alr1 reverse:
                                    (SEQ ID NO: 204)
5'-ATAAAAGCTTTTAAAAATCGGCTTTAAGTACAATCCGATAAC
```

The plasmid pETDuet-1-'tesA-alrAadp1 was prepared by inserting the alrAadp1 gene (gene locus-tag="ACIAD3612"), a homolog of *Acinetobacter baylyi* ADP1, into the NcoI and HindIII sites of pETDuet-1-'tesA.

B. Evaluation of Fatty Aldehyde and Fatty Alcohol Production

In order to evaluate the affect of carboxylic acid reductases and alcohol dehydrogenases on the production of fatty alcohols, various combinations of the prepared plasmids were transformed in the *E. coli* strain C41 (DE3, ΔfadE) (described in PCT/US08/058,788).

For example, the plasmid pACYCDuet-1-carA, encoding the CAR homolog carA, was co-transformed with pETDuet-1-'tesA-alrAadp1 (see, e.g., FIG. 1).

The plasmid pACYCDuet-1-carB, encoding the CAR homolog carB, was co-transformed with pETDuet-1-'tesA. In addition, pACYCDuet-1-carB was also separately co-transformed with pETDuet-1-'tesA-yjgB and pETDuet-1-'tesA-alrAadp1. As a control, pACYCDuet-1-carB was co-transformed with the empty vector pETDuet-1 (see, e.g., FIG. 1).

The plasmid pACYCDuet-1-fadD9, encoding the CAR homolog fadD9, was co-transformed with pETDuet-1-'tesA. In addition, pACYCDuet-1-fadD9 was also separately co-transformed with pETDuet-1-'tesA-yjgB and pETDuet-1-'tesA-alrAadp1. As a control, pACYCDuet-1-fadD9 was co-transformed with the empty vector pETDuet-1 (see, e.g., FIG. 1).

As an additional control, pETDuet-1-'tesA-yjgB was co-transformed with the empty vector pACYCDuet-1.

The *E. coli* transformants were grown in 3 mL of LB medium supplemented with carbenicillin (100 mg/L) and chloramphenicol (34 mg/L) at 37° C. After overnight growth, 15 µL of culture was transferred into 2 mL of fresh LB medium supplemented with carbenicillin and chloramphenicol. After 3.5 hours of growth, 2 mL of culture were transferred into a 125 mL flask containing 20 mL of M9 medium with 2% glucose and with carbenicillin and chloramphenicol. When the $OD_{600}$ of the culture reached 0.9, 1 mM of IPTG was added to each flask. After 20 hours of growth at 37° C., 20 mL of ethyl acetate (with 1% of acetic acid, v/v) was added to each flask to extract the fatty alcohols produced during the fermentation. The crude ethyl acetate extract was directly analyzed with GC/MS as described herein.

The measured retention times were 6.79 minutes for cis-5-dodecen-1-ol, 6.868 minutes for 1-dodecanol, 8.058 minutes for cis-7-tetradecen-1-ol, 8.19 minutes for 1-tetradecanol, 9.208 minutes for cis-9-hexadecen-1-ol, 9.30 minutes for 1-hexadecanol, and 10.209 minutes for cis-11-octadecen-1-ol.

Figure 2:
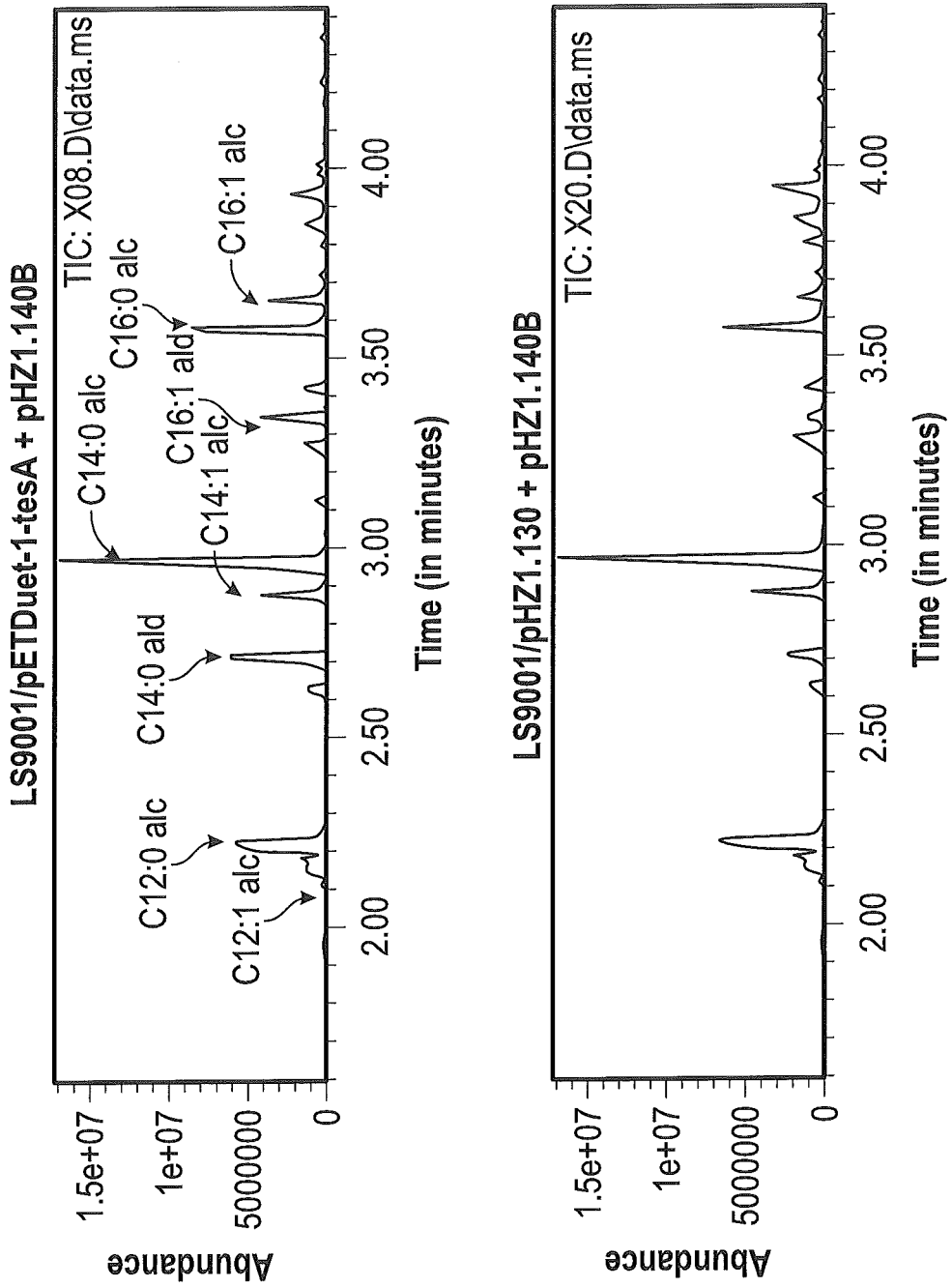
FIG. 2 is a graphic representation of two GC/MS traces of organic compounds produced by recombinant *E. coli* strains transformed with various plasmids.
Figure 5A:
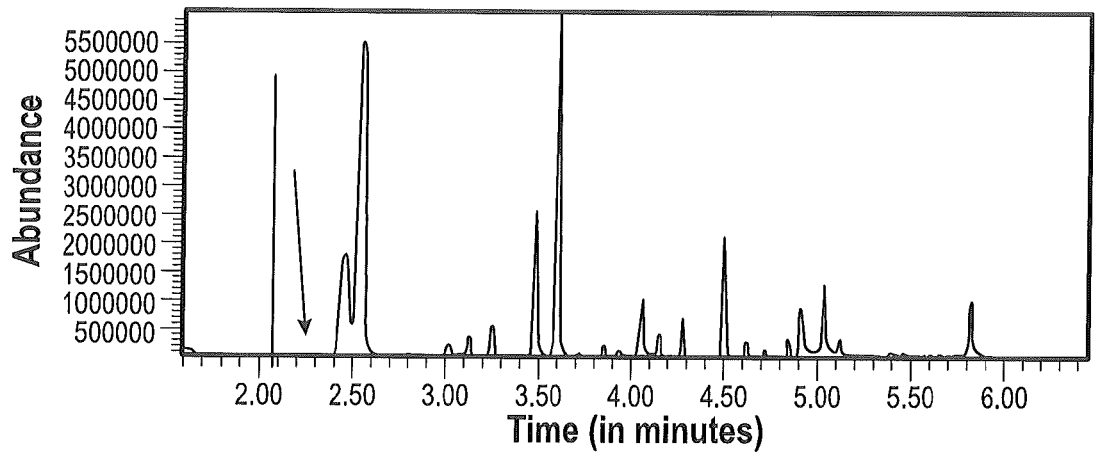
FIG. 5A is a GC/MS trace of fatty alcohol production in MG1655(DE3, ΔfadD)/pETDUet-1-tesA+pHZ1.140B cells.
Figure 5B:
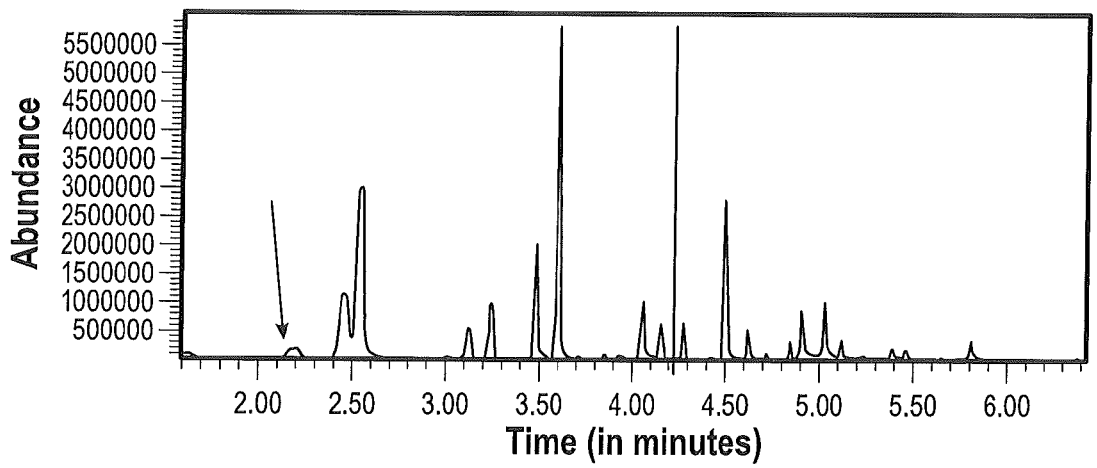
FIG. 5B is a GC/MS trace of fatty alcohol production in MG16655(DE3, ΔfadD, yjgB::kan)/pETDUet-1-tesA+pHZ1.140B cells.
Figure 5C:
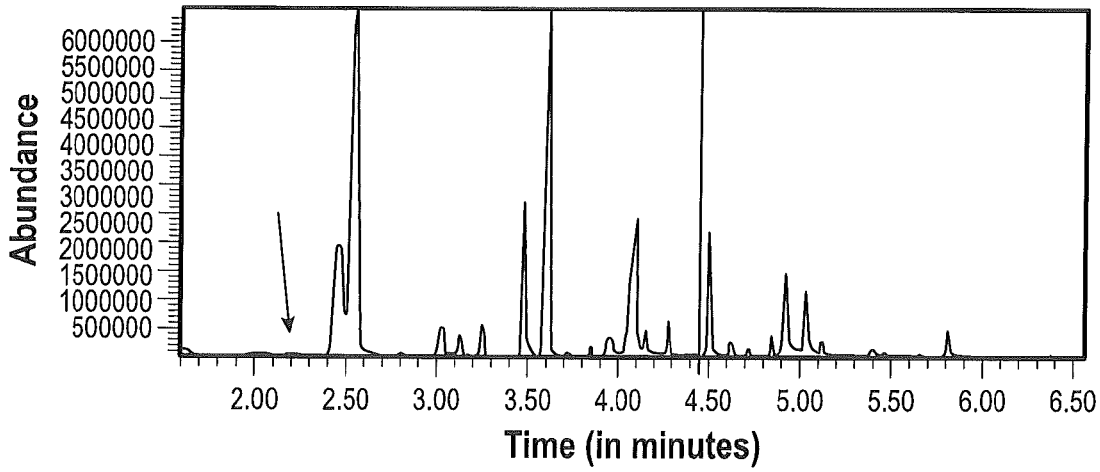
FIG. 5C is a GC/MS trace of fatty alcohol production in MG16655(DE3, ΔfadD, yjgB::kan)/pDF1+pHZ1.140B cells. The arrows in FIG. 5A, FIG. 5B, and FIG. 5C indicate the absence of C12:0 fatty aldehydes.

The co-expression of the leaderless tesA and any of the three car genes in *E. coli* resulted in high titers of fatty alcohols and detectable fatty aldehyde production (FIGS. 1, 2, 5). The expression of carA or carB with the leaderless tesA and alrAadp1 resulted in fatty alcohol titers of greater than 700 mg/L and reduced fatty aldehyde production. Likewise, fadD9 co-expressed with the leaderless tesA and alrAadp1 produced over 300 mg/L of fatty alcohol. When expressed without the leaderless tesA, neither carB nor fadD9 produced more than 10 mg/L of fatty alcohols (possibly resulting from the accumulation of free fatty acids in the cell due to endogenous tesA). Taken together, this data indicates that fatty acids are the substrates for these CAR homologs and that overexpression of a thioesterase, such as 'tesA (to release fatty acids from acyl-ACP), achieves significant production of fatty alcohols.

In one fermentation, *E. coli* strain C41 (DE3, ΔfadE) co-transformed with pACYCDuet-1-carB+pETDuet-1-tesA produced an average of 695 mg/L of fatty alcohols and 120 mg/L of fatty aldehydes. The presence of large amounts of fatty aldehydes is consistent with CAR being an aldehyde-generating, fatty acid reductase (AFAR). This mechanism is different from alcohol-generating fatty acyl-CoA reductases (FAR), represented by JjFAR, and fatty acyl-CoA reductases, represented by Acr1.

The production of fatty alcohols from fatty aldehydes in the *E. coli* strains described above may have been catalyzed by an endogenous alcohol dehydrogenase(s). *E. coli* produces an alcohol dehydrogenase(s) (e.g., yjgB) capable of converting fatty aldehydes of various chain-length into fatty alcohols (Naccarato et al., *Lipids* 9: 419-428 (1974); Reiser et al., *J. Bacteriol.* 179: 2969-2975 (1997); Venkitasubramanian et al., *J. Biol. Chem.* 282:478-485 (2007)).

Therefore, alcohols dehydrogenases may also play a role in the fatty alcohol biosynthetic pathway in addition to carboxylic acid reductases. For example, expression of either yjgB or alrAadp1 with carB and the leaderless tesA significantly reduced the accumulation of fatty aldehydes, compared to strains that did not overexpress yjgB or alrAadp1 (FIG. 2).

Following the fermentations where pACYCDuet-1-carB was transformed in *E. coli* strain C41 (DE3, ΔfadE), a white, round, disk-like deposit was observed at the bottom center of the flasks used for fatty alcohol production with recombinant *E. coli* strains. In contrast, no such deposits were observed at the bottom of the control flasks that did not express car homologs. GC/MS analysis of the deposit dissolved in ethyl acetate (with 1% of acetic acid, v/v) revealed that the deposit was a fatty alcohol deposit.

C. Types of Fatty Alcohols Produced by Different CAR Homologs

Depending upon the CAR homolog expressed in *E. coli* strain C41 (DE3, ΔfadE), different mixtures of fatty alcohols were produced. Different compositions of fatty alcohols were observed among the three CAR homologs evaluated (see Table 10). FadD9 produced more $C_{12}$ fatty alcohols relative to other fatty alcohols with carbon chain lengths greater than 12.

Both CarA and CarB produced a wider range in chain length of fatty alcohols than was observed when expressing FadD9.

TABLE 10

Acyl-composition of fatty alcohols produced by recombinant *E. coli* strains

| Expressed with TesA* and AlrAadp1 | Acyl-composition of fatty alcohols (%) | | | | | | |
|---|---|---|---|---|---|---|---|
| | C10:0 | C12 | C14:1 | C14:0 | C16:1 | C16:0 | C18:1 |
| CarA | trace | 38 | 13 | 27 | 16 | 4 | 3 |
| FadD9 | trace | 63 | 14 | 16 | 7 | trace | trace |
| CarB | trace | 32 | 11 | 41 | 12 | trace | trace |

*the leaderless TesA. C12, including C12:0 and C12:1 fatty alcohol.

D. Quantification and Identification of Fatty Alcohols

Gas chromatography—mass spectrometry (GC/MS) was performed using an Agilent 5975B MSD system equipped with a 30 m×0.25 mm (0.10 µm film) DB-5 column. The column temperature was 3 min isothermal at 100° C. The column was programmed to rise from 100° C. to 320° C. at a rate of 20° C./min. When the final temperature was reached, the column remained isothermal for 5 minutes at 320° C. The injection volume was 1 µL. The carrier gas, helium, was released at 1.3 mL/min. The mass spectrometer was equipped with an electron impact ionization source. The ionization source temperature was set at 300° C.

Prior to quantification, various alcohols were identified using two methods. First, the GC retention time of each compound was compared to the retention time of a known standards, such as cetyl alcohol, dodecanol, tetradecanol, octadecanol, and cis-9-octadecenol. Second, identification of each compound was confirmed by matching the compound's mass spectrum to a standard's mass spectrum in the mass spectra library (e.g., C12:0, C12:1, C13:0, C14:0, C14:1, C15:0. C16:0, C16:1, C17:0, C18:0 and C18:1 alcohols).

Example 4

Production of Fatty Alcohol by Heterologous Expression of CAR Homologs in *E. coli* MG1655 (DE3, ΔfadD)

Construction of fadD Deletion Strain

The fadD gene of *E. coli* MG1655 was deleted using the lambda red system (Datsenko et al., 2000, Proc. Natl. Acad. Sci. USA. 97: 6640-6645) as follows:
The chloramphenicol acetyltransferase gene from pKD3 was amplified with the primers fad1 (5'-TAACCGGCGTCT-GACGACTGACTTAACGCTCAGGCTTTAT-TGTCCACTTTG TGTAGGCTGGAGCTGCTTCG-3') (SEQ ID NO:205), and fad2 (5'-CATTTGGGGTTGCGAT-GACGACGAACACGCATTTTAGAGGTGAAGAATTG CATATGAATATCCTCCTTTAGTTCC-3') (SEQ ID NO:206).
This PCR product was electroporated into *E. coli* MG1655 (pKD46). The cells were plated on L-chloramphenicol (30 µg/mL) (L-Cm) and grown overnight at 37° C. Individual colonies were picked on to another L-Cm plate and grown at 42° C. These colonies were then patched to L-Cm and L-carbenicillin (100 mg/mL) (L-Cb) plates and grown at 37° C. overnight. Colonies that were Cm$^R$ and Cb$^S$ were evaluated further by PCR to ensure the PCR product inserted at the correct site. PCR verification was performed on colony lysates of these bacteria using the primers fadF (5'-CGTC-CGTGGTAATCATTTGG-3') (SEQ ID NO:207) and fadR (5'-TCGCAACCTTTTCGTTGG-3') (SEQ ID NO:208).

Figure 4:
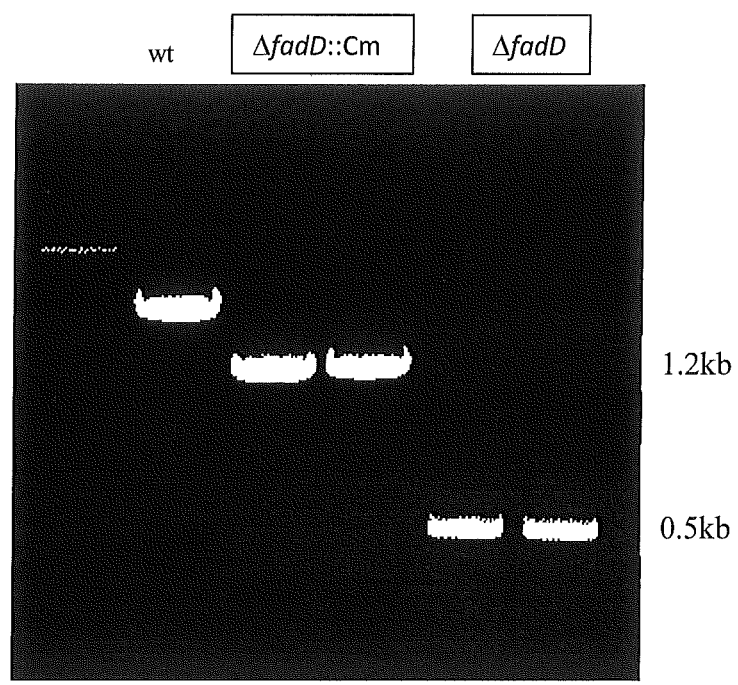
FIG. 4 is a representation of a gel of PCR products from MG1655 wild type cells, ΔfadD::cm cells, and ΔfadD cells.

Expected size of the ΔfadD::Cm deletion was about 1200 bp (FIG. 4). The chloramphenicol resistance gene was eliminated using a FLP helper plasmid as described in Datsenko et al., Proc. Natl. Acad. Sci. USA 97:6640-6645 (2000). PCR verification of the deletion was performed with primers fadF and fadR (FIG. 4). The MG1655 ΔfadD strain was unable to grow on M9+oleate agar plates (oleate as carbon source). It was also unable to grow in M9+oleate liquid media. The growth defect was complemented by an *E. coli* fadD gene supplied in trans (in pCL1920-Ptrc).

Construction of MG1655(DE3, ΔfadD) Strain

To generate a T7-responsive strain, the λDE3 Lysogenization Kit (Novagen) was utilized, which is designed for site-specific integration of λDE3 prophage into an *E. coli* host chromosome, such that the lysogenized host can be used to express target genes cloned in T7 expression vectors. λDE3 is a recombinant phage carrying the cloned gene for T7 RNA polymerase under lacUV5 control. Briefly, the host strain was cultured in LB supplemented with 0.2% maltose, 10 mM MgSO$_4$, and antibiotics at 37° C. to an OD$_{600}$ of 0.5. Next, 10$^8$ pfu λDE3, 10$^8$ pfu Helper Phage, and 10$^8$ pfu Selection Phage were incubated with 10 µL host cells. The host/phage mixture was incubated at 37° C. for 20 min to allow phage to adsorb to host. Finally, the mixture was pipeted onto an LB plate supplemented with antibiotics. The mixture was spread evenly using plating beads, and the plates were inverted plates and incubated at 37° C. overnight.

λDE3 lysogen candidates were evaluated by their ability to support the growth of the T7 Tester Phage. T7 Tester Phage is a T7 phage deletion mutant that is completely defective unless active T7 RNA polymerase is provided by the host cell. The T7 Tester Phage makes very large plaques on authentic λDE3 lysogens in the presence of IPTG, while much smaller plaques are observed in the absence of inducer. The relative size of the plaques in the absence of IPTG is an indication of the basal level expression of T7 RNA polymerase in the lysogen, and can vary widely between different host cell backgrounds.

The following procedure was used to determine the presence of DE3 lysogeny. First, candidate colonies were grown in LB supplemented with 0.2% maltose, 10 mM MgSO$_4$, and antibiotics at 37° C. to an OD$_{600}$ of 0.5. An aliquot of T7 Tester Phage was then diluted in 1× Phage Dilution Buffer to a titer of 2×10$^3$ pfu/mL. In duplicate tubes, 100 µL host cells were mixed with 100 µL diluted phage. The host/phage mixture was incubated at room temperature for 10 min to allow phage to adsorb to host. Next, 3 mL of molten top agarose was added to each tube containing host and phage. The contents of one duplicate were plated onto an LB plate and the other duplicate onto an LB plate supplemented with 0.4 mM IPTG (isopropyl-b-thiogalactopyranoside) to evaluate induction of T7 RNA polymerase. Plates were allowed to sit undisturbed for 5 min until the top agarose hardened. The plates were then inverted at 30° C. overnight.

Construction of MG1655(DE3, ΔfadD, yjgB::kan) Strain

The yjgB knockout strain, MG1655(DE3, ΔfadD, yjgB::kan), was constructed by using the following lambda red system (Datsenko et al., *Proc. Natl. Acad. Sci. USA* 97:6640-6645 (2000)):

The kanamycin resistant gene from pKD13 was amplified with the primers yjgBRn (5'-GCGCCTCAGATCAGCGCT-GCGAATGATTTTCAAAAATCGGCTTTCAACAC TGTAGGCTGGAGCTGCTTCG-3') (SEQ ID NO:209), and yjgBFn (5'-CTGCCATGCTCTACACTTCCCAAACAA-CACCAGAGAAGGACCAAAAAATG ATTCCGGG-GATCCGTCGACC-3') (SEQ ID NO:210). The PCR product was then electroporated into *E. coli* MG1655(DE3, ΔfadD)/pKD46. The cells were plated on kanamycin (50 μg/mL) (L-Kan) and grown overnight at 37° C. Individual colonies were picked on to another L-Kan plate and grown at 42° C. These colonies were then patched to L-Kan and carbenicillin (100 mg/mL) (L-Cb) plates and grown at 37° C. overnight. Colonies that were kan$^R$ and Cb$^S$ were evaluated further by PCR to ensure the PCR product was inserted at the correct site. PCR verification was performed on colony lysates of these bacteria using the primers BF (5'-gtgctggcgataCGA-CAAAACA-3') (SEQ ID NO:211) and BR (5'-CCCCGC-CCTGCCATGCTCTACAC-3') (SEQ ID NO:212). The expected size of the yjgB::kan knockout was about 1450 bp. Evaluation of FadD on Fatty Alcohol Production Using MG1655(DE3, ΔfadD) Strain In Example 3, a fadE deletion strain was used for fatty aldehyde and fatty alcohol production from 'TesA, CAR homologs, and endogenous alcohol dehydrogenase(s) in *E. coli*. To demonstrate that CAR homologs used fatty acids instead of acyl-CoA as a substrate, the gene encoding for acyl-CoA synthase in *E. coli* (fadD) was deleted so that the fatty acids produced were not activated with CoA. *E. coli* strain MG1655(DE3, ΔfadD) was transformed with pET-Duet-1-'tesA and pACYCDuet-1-carB. The transformants were evaluated for fatty alcohol production using the methods described herein. These transformants produced about 360 mg/L of fatty alcohols (dodecanol, dodecenol, tetredecanol, tetredecenol, cetyl, hexadecenol, and octadecenol).

YjgB is an Alcohol Dehydrogenase

To confirm that YjgB was an alcohol dehydrogenase responsible for converting fatty aldehydes into their corresponding fatty alcohols, pETDuet-1-'tesA and pACYCDuet-1-fadD9 were co-transformed into either MG1655(DE3, ΔfadD) or MG1655(DE3, ΔfadD, yjgB::kan). At the same time, MG1655(DE3, ΔfadD, yjgB::kan) was transformed with both pETDuet-1-'tesA-yjgB and pACYCDuet-1-fadD9.

The *E. coli* transformants were grown in 3 mL of LB medium supplemented with carbenicillin (100 mg/L) and chloramphenicol (34 mg/L) at 37° C. After overnight growth, 15 μL of culture was transferred into 2 mL of fresh LB medium supplemented with carbenicillin and chloramphenicol. After 3.5 hrs of growth, 2 mL of culture was transferred into a 125 mL flask containing 20 mL of M9 medium with 2% glucose, carbenicillin, and chloramphenicol. When the OD$_{600}$ of the culture reached 0.9, 1 mM of IPTG was added to each flask. After 20 hrs of growth at 37° C., 20 mL of ethyl acetate (with 1% of acetic acid, v/v) was added to each flask to extract the fatty alcohols produced during the fermentation. The crude ethyl acetate extract was directly analyzed with GC/MS as described herein.

The yjgB knockout strain resulted in significant accumulation of dodecanal and a lower fatty alcohol titer (FIG. 5). The expression of yjgB from plasmid pETDuet-1-'tesA-yjgB in the yjgB knockout strain effectively removed the accumulation of dodecanal (FIG. 5). The data shows that YjgB was involved in converting dodecanal into dodecanol and that there may be other alcohol dehydrogenase(s) present in *E. coli* to convert other aldehydes into alcohols. Dodecanal accumulated in the yjgB knockout strain, but it was not observed in either the wild-type strain (MG1655(DE3, ΔfadD)) or the yjgB knockout strain with the yjgB expression plasmid. The arrows (in FIG. 5) indicate the GC trace of dodecanal (C12:0 aldehyde).

Example 5

Production of Saturated Fatty Alcohols in *E. coli*

Fatty alcohols for commercial uses are saturated. However, *E. coli* typically has a certain amount (about 20-25%) of unsaturated fatty acids in its membrane to maintain fluidity. An *E. coli* strain was engineered that was able to produce exclusively saturated fatty acids in a medium not supplemented with unsaturated fatty acid or cyclopropane-fatty acid and was able to produce saturated fatty alcohols.

Two enzymes, a dehydratase/isomerase and a ketoacylsynthase I (KASI), encoded by fabA and fabB, respectively, are involved in unsaturated fatty acid biosynthesis. Usually, an *E. coli* strain lacking either FabA or FabB does not survive without supplementation of unsaturated fatty acids, such as oleate. To overcome this, the fabB gene was knocked out of an *E. coli* host strain, and the strain was able to grow without unsaturated fatty acid supplementation by genetically engineering the cells to express a recombinant desaturase gene (AF037430, encoding DesA) from *Bacillus subtilis*. Although the first generation of the strain expressing desA required oleate for normal growth, subsequent plating of the strain on L Agar plates several times resulted in a strain that did not require oleate for growth.

Materials

*E. coli* JWC280 cells (described in Campbell et al., *Mol. Microbiol.* 47:793-805 (2003)) and *E. coli* GRT23 cells (described in Morgan-Kiss et al., *Arch. Microbiol.* 190:427-437 (2008)) were obtained from John Cronan.

Plasmid Construction

The desA gene (also referred to as Δ5 des) was amplified with primers delta5Fn and delta5Rn (listed in Table 11) from the genomic DNA of *Bacillus subtilis* str. 168 and digested with AvrII and EcoRI. The desA gene was then cloned into pET-21(a), which had been linearized with AvrII-EcoRI, to produce pET-21a-Δ5. The desA gene was then removed as an NdeI-EcoRI fragment from pET-21a-Δ5 and inserted between the NdeI and EcoRI sites of OP180, a pACYC derived plasmid carrying a trc promoter. The resultant plasmid was named pACYC-Δ5.

A desA_kan gene cassette was cloned between the AvrII-BamHI sites of CDFDuet-1. A kan gene cassette was produced by EcoRI and BamHI digestion of a PCR product that was amplified with primers kanF and kanR (see Table 11) from pKD13 as the template (pKD13 was obtained from The Coli Genetic Stock Center, Yale University, and is described in Datsenko et al., *Proc. Natl. Acad. Sci. USA* 97:6640-6645 (2000)). The amplified desA gene (described above) was digested with AvrII and EcoRI. The AvrII-EcoRI fragment of the desA gene and the EcoRI-BamHI fragment of the kan gene were then inserted between the AvrII-BamHI sites of pCDFDuet-1 (from EMD Chemicals, Gibbstown, N.J.) to produce a plasmid that was named pCDFDuet-1-Δ5-kan.

A p84.17fabBΔ5kan plasmid was constructed to replace fabB with the desA_kan cassette by several subcloning steps. First, a DNA fragment (L-fabB) flanking the upstream region of fabB was amplified with primers fabBLF and fabBLR (see Table 11), and a DNA fragment (R-fabB) flanking the downstream region of fabB was amplified with primers fabBRF and fabBRR (see Table 11) from E. coli MG1655 genomic DNA. Second, L-fabB was digested with XbaI and BglII, and R-fabB was digested with NotI and BglII. The digested L-fabB and R-fabB fragments were purified from agarose gel and were ligated with XbaI-NotI linearized pKOV. The resultant plasmid was designated pHZ1.186. Next, the desA_kan gene cassette was removed from pCDFDuet-1-Δ5-kan as an AvrII-BamHI fragment and was inserted between the AvrII and BglII sites of pHZ1.186, resulting in the desA_kan gene cassette being sandwiched by L-fabB and R-fabB. Finally, the L-fabB-desA_kan-R-fabB fragment was amplified with fabBLF and fabBRR (see Table 11) from pHZ1.186 and cloned into the two PvuII sites of pMOD-4-MCS (Epicentre Biotechnologies, Madison, Wis.). The final plasmid was designated p84.17fabB.

DNA spanning from about 1 kb upstream to about 1 kb downstream of fabB::cm was amplified from the genome of GRT23 cells using the primers fabBup and fabBdowm (see Table 11). The amplified DNA fragment was then digested with PvuII and inserted between the two PvuII sites of pMOD-4-MCS. The resulting plasmid was designated p84.15.

The genes encoding a thioesterase ('TesA) and a fatty acid reductase (CarB) were cloned as an operon, and the operon was placed under the trc promoter and pCL1920 vector. The final plasmid was named pCL-Ptrc-carB_'tesA (the sequence is listed in FIG. 17 as SEQ ID NO:213).

TABLE 11

Primer sequences

| Primer ID | Sequence |
| --- | --- |
| delta5Fn | TTTT CCTAGG ATG ACT GAA CAA ACC A (SEQ ID NO: 214) |
| delta5Rn | TTTT GAATTC TTA TCA TTG TGA AAG CCAGAA (SEQ ID NO: 215) |
| kanF | TTTT GAATTC TGT AGG CTG GAG CTG CTTCG (SEQ ID NO: 216) |
| kanR | ATTCCG GGG ATC CGT CGA CC (SEQ ID NO: 217) |
| fabBLF | TTTT CTA GAA ATA GCG CCA GCG ACA (SEQ ID NO: 218) |
| fabBLR | TTTT AGA TCT TAG CCC TAG GCC AGT AAT CAC TGC ACG (SEQ ID NO: 219) |
| fabBRF | TTTT AGA TCT AGC TTC GGC TTC GGC G (SEQ ID NO: 220) |
| fabBRR | TTTT GCG GCC GCG CCC ATC CTT TGC TGG C (SEQ ID NO: 221) |
| fabBup | ACG ACA AAT GCG CCG C (SEQ ID NO: 222) |
| fabBdown | ATC CGC GCA ATA AAG C (SEQ ID NO: 223) |

Strain Construction

An E. coli MG1655 (ΔfadEΔfhuAfabB::cm)/pACYC-Δ5 strain was constructed by transforming p84.15fabB into MG1655 (ΔfadEΔfhuA)/pACYC-Δ5. Plasmid p84.17fabB was transformed into MG1655 (ΔfadEΔfhuAfabB::cm)/pACYC-Δ5 to produce MG1655 (ΔfadEΔfhuAfabB::desA_kan)/pACYC-Δ5. After each transformation, the transformant mix was plated onto L agar plates supplemented with 1 mM IPTG and appropriate antibiotics (17 mg/L of chloramphenicol or 50 mg/L of kanamycin).

MG1655 (ΔfadEΔfhuAfabB::desA_kan)/pACYC-Δ5 grew normally in L Broth supplemented with oleate (potassium salt, 50 mg/L). Cells were plated onto L agar plates supplemented with 50 mg/L of oleate and incubated at 37° C. for 2 days. Colonies were then patched onto L Agar plates, supplemented with 50 mg/L of oleate and 100 mg/L of carbenicillin. One of the colonies, which lost resistance to carbenicillin but retained kanamycin resistance, was streaked onto an L agar plate supplemented with 50 mg/L of kanamycin, but no oleate. One of the colonies was selected from the plate and was designated ALC119A.

ALC119A with a Fatty Alcohol Pathway Produced Almost Exclusive Saturated Fatty Alcohol Plasmid pCL-Ptrc-carB_'tesA was transformed into the ACL119A strain. Three transformants of ALC119A/pCL-Ptrc-carB_'tesA were grown in 3 mL of L broth with 100 mg/L of spectinomycin in a 37° C. shaker overnight. 15 µL of the overnight culture were transferred into 2 mL of fresh L broth with 100 mg/L of spectinomycin and 2 µL of 70% potassium oleate. The fresh inoculation was placed in a 37° C. shaker for about 3 hrs. The 2 mL culture was then transferred into 20 mL of V9 medium (Hu-9 medium without ferric chloride) in a 125 mL baffle flask. When the $OD_{600}$ of the culture reached about 0.9, 1 mM of IPTG was added to each flask. After 20 hrs of growth at 37° C., 20 mL of ethyl acetate (with 1% of acetic acid, v/v) was added to each flask to extract the fatty alcohols produced during the fermentation. The crude ethyl acetate extract was directly analyzed with GC/MS as described in WO 2008/119082. Cetyl alcohol was used as a reference for quantification of fatty alcohol.

Figure 13:
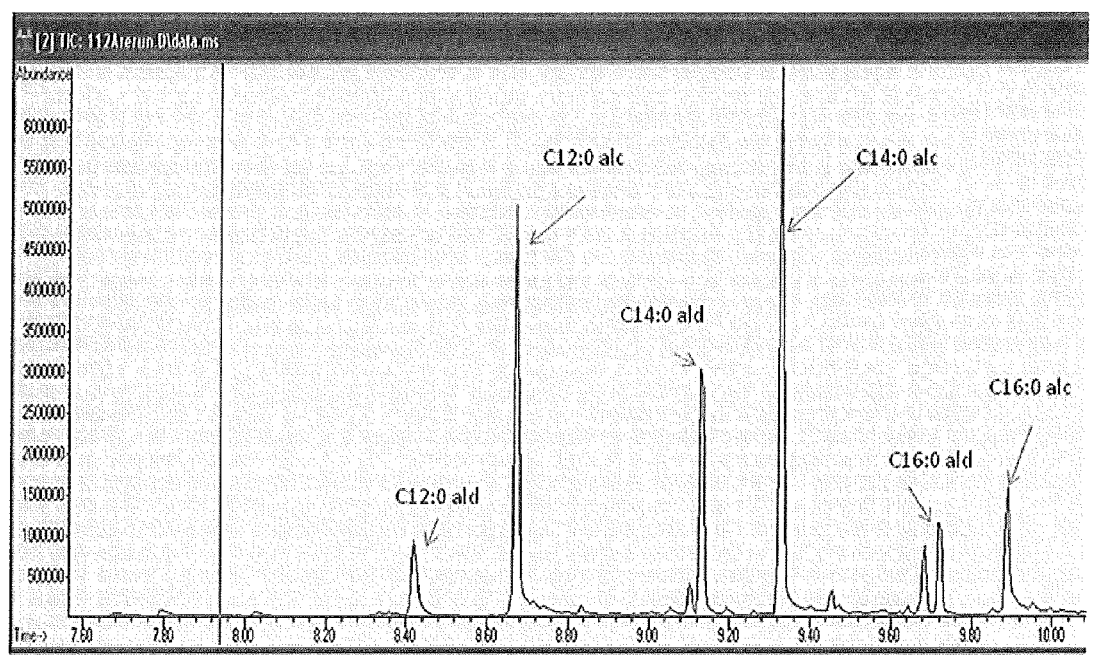
FIG. 13 is a GC/MS trace of saturated fatty alcohol production in *E coli*.

As shown in FIG. 13, the ALC119A/pCL-Ptrc-carB_'tesA strain produced almost exclusively saturated fatty alcohols, including dodecanol, tetradecanol and hexadecanol.

Example 6

Production of Fatty Alcohols in the Cyanobacterium Synechococcus sp. PCC7002

This example describes the use of photoautotrophic bacteria to produce fatty alcohols from carbon dioxide (instead of glucose) using the carB-'tesA-yahK pathway. First, a vector is constructed for homologous recombination into the Synechococcus sp. PCC7002 plasmid pAQ1 (genbank accession NC_0050525) using 500 bp homologous regions corresponding to positions 3301-3800 and 3801-4300 of pAQ1. As a selectable marker, a spectinomycin resistance cassette containing the aminoglycoside 3' adenylyltransferase, aad, promoter, gene and terminator (from plasmid pCL1920), is added between the homologous regions. For gene expression, the promoter and ribosome binding site of aminoglycoside phosphotransferase, aph (from plasmid pACYC177), is added followed by the unique cloning sites NdeI and EcoRI for insertion of a heterologous gene or operon. This complete integration cassette is constructed by gene synthesis and cloned into pUC19 for maintenance and delivery. The resulting plasmid, pLS9-7002, allows (i) cloning and expression of a foreign gene, and (ii) delivery and stable in vivo integration into Synechococcus sp. PCC7002 plasmid pAQ1.

The fatty alcohol pathway for expression in Synechococcus sp. PCC7002 is constructed as follows. The carB-'tesA operon from pCL-Ptrc-carB-'tesA (described in Example 4) is extended by adding yahK downstream of 'tesA and then cloning into the NdeI and EcoRI sites of pLS9-7002 downstream of the aph promoter and ribosome binding site. The resulting plasmid is transformed into *Synechococcus* sp. PCC7002 as described by Stevens et al. (*Proc. Natl. Acad. Sci. U.S.A.* 77:6052-6056 (1980)). Stable integrants are selected for on ATCC 1047 medium supplemented with 15 μg/mL spectinomycin. 1 L of ATCC 1047 medium contains 40 mg $MgSO_4 \times 7H_2O$, 20 mg $CaCl_2 \times 2\,H_2O$, 750 mg $NaNO_3$, 2 mg $K_2HPO_4$, 3.0 mg citric acid, 3.0 mg ferric ammonium citrate, 0.5 mg EDTA, 20 mg $Na_2CO_3$, 2.86 mg $H_3BO_3$, 1.81 mg $MnCl_2$, 0.22 mg $ZnSO_4$, 0.04 mg $Na_2MoO_4$, 0.08 mg $CuSO_4$, 0.05 mg $Co(NO_3)_2$, 0.02 mg vitamin B12, 10 g agar, and 750 mL sea water. Spectinomycin resistant colonies are restreaked several times on ATCC medium 1047 with spectinomycin and tested for isogenic intergration of the carB-'tesA-yahK operon by PCR with primers pAQ1-U (atgtctgacaagggttgacccct) (SEQ ID NO:224) and pAQ1-D (gcacatccttatccaattgctctag) (SEQ ID NO:225). Complete isogenic carB-'tesA-yahK integrants are then grown in 50 mL liquid ATCC 1047 medium with spectinomycin in 500 mL shake flasks with appropriate aeration and illumination at 30° C. for five to seven days. Culture aliquots are extracted at various time points with an equal volume of ethyl acetate and the extracts are analyzed for fatty alcohol production as described in Example 3. Fatty alcohols are produced.

Example 7

Production of Fatty Alcohols in the Cyanobacterium *Synechococcus elongatus* PCC7942

This example describes a second method of using photoautotrophic bacteria to produce fatty alcohols from carbon dioxide (instead of glucose) using the carB-'tesA-yahK pathway. First, a vector is constructed for homologous recombination into the *Synechococcus elongatus* PCC7942 genome (genbank accession CP_000100) using 800 bp homologous regions corresponding to positions 2577844-2578659 and 2578660-2579467 of CP_000100. This chromosomal location is known as neutral site one (NS1) (Mackey et al., *Meth. Mol. Biol.* 362:115-129 (2007)). As a selectable marker, a spectinomycin resistance cassette containing the aminoglycoside 3' adenylyltransferase, aad, promoter, gene and terminator (from plasmid pCL1920), is added between the homologous regions. Additionally, the unique cloning sites NdeI and EcoRI are added for insertion of a heterologous gene or operon. This integration cassette is constructed by gene synthesis and cloned into pUC19 for maintenance and delivery. The resulting plasmid, pLS9-7942_NS1, allows (i) cloning and expression of a foreign gene and (ii) delivery and stable in vivo integration into the *Synechococcus elongatus* PCC7942 genome.

The complete carB-'tesA-yahK operon (described in Example 6), including its ptrc promoter and ribosome binding site, is cloned into the NdeI or EcoRI site of pLS9-7942_NS1. The resulting plasmid is transformed into *S. elongatus* PCC7942 as described by Mackey et al., *Meth. Mol. Biol.* 362:115-129 (2007). Stable integrants are selected for on BG-11 medium supplemented with 4 μg/mL spectinomycin. 1 L of BG-11 medium contains 75 mg $MgSO_4 \times 7\,H_2O$, 36 mg $CaCl_2 \times 2\,H_2O$, 1.5 g $NaNO_3$, 40 mg $K_2HPO_4$, 6.0 mg citric acid, 6.0 mg ferric ammonium citrate, 1.0 mg EDTA, 20 mg $Na_2CO_3$, 2.86 mg $H_3BO_3$, 1.81 mg $MnCl_2$, 0.22 mg $ZnSO_4$, 0.04 mg $Na_2MoO_4$, 0.08 mg $CuSO_4$, 0.05 mg $Co(NO_3)_2$, and 10 g agar. Spectinomycin resistant colonies are restreaked several times on BG-11 medium with spectinomycin and tested for isogenic integration of the carB-'tesA-yahK operon by PCR with primers NS1-U (gatcaaacaggtgcagcagcaactt) (SEQ ID NO:226) and NS1-D (attcttgacaagcgatcgcggtcac) (SEQ ID NO:227). Complete isogenic carB-'tesA-yahK integrants are then grown in 50 mL liquid BG-11 medium with spectinomycin in 500 mL shake flasks with appropriate aeration and illumination at 30° C. up to seven days. Culture aliquots are extracted at various time points with an equal volume of ethyl acetate and the extracts are analyzed for fatty alcohol production as described in Example 3. Fatty alcohols are produced.

Example 8

Malonyl-CoA-Independent Production of Fatty Alcohols in *E. coli*

Certain protists such as *Euglena gracilis* are capable of malonyl-CoA independent fatty acid biosynthesis. The biosynthetic machinery for this pathway is located in the mitochondria and is thought to reverse the direction of β-oxidation by using acetyl-CoA as priming as well as elongating substrates to produce $C_8$ to $C_{18}$ fatty acids (Inui et al., *Eur. J. Biochem.* 142:121-126 (1984)). The enzymes involved are trans-2-enoyl-CoA reductases (TER), which catalyze the irreversible reduction of trans-2-enoyl-CoA to acyl-CoA and thereby drive the otherwise reversible pathway in the reductive direction (while the opposite is true for β-oxidation, where the irreversible acyl-CoA dehydrogenase, FadE, drives the reaction in the oxidative direction). One TER gene from *E. gracilis* as well as other eukaryotic and prokaryotic homologs are known (Hoffmeister et al., *J. Biol. Chem.* 280:4329-4338 (2005); Tucci et al., *FEBS Lett.* 581:1561-1566 (2007)). The only known TER enzyme from *E. gracilis* has been shown in vitro to reduce trans-2-butenoyl-CoA (C4) and trans-2-hexenoyl-CoA (C6) to the respective acyl-CoAs, (longer-chain trans-2-enoyl-CoAs have not been tested). Currently, very little is known about the other pathway enzymes in *E. gracilis*.

A pathway that creates a flux exclusively from acetyl-CoA precursors to acyl-CoA (as in *Euglena gracilis* mitochondria) can be engineered in *E. coli* using different sets of enzymes with the following four enzymatic activities: (i) non-decarboxylating, condensing thiolase, (ii) 3-ketoacyl-CoA reductase (or 3-hydroxyacyl-CoA dehydrogenase), (iii) 3-hydroxyacyl-CoA hydratase (or enoyl-CoA dehydratase) and (iv) trans-2-enoyl-CoA reductase. All four enzymes can have sufficiently relaxed chain lengths specificity to allow synthesis of acyl-CoAs with longer chain length, e.g., $C_{12}$ or $C_{14}$.

A plasmid encoding all four activities is constructed as follows. A synthetic operon of *E. coli* fadA (YP_026272) (shown in FIG. 17 as SEQ ID NO:229) (non-decarboxylating thiolase) and fadB (NP_418288) (shown in FIG. 17 as SEQ ID NO:231) (3-hydroxyacyl-CoA dehydrogenase and enoyl-CoA dehydratase) and *E. gracilis* ter (Q5EU90) (shown in FIG. 17 as SEQ ID NO:228) (trans-2-enoyl-CoA reductase, codon optimized without its 5' sequence encoding a transit peptide) is constructed and cloned downstream of a ptrc promoter into a pACYC plasmid with a carbenicillin or chloramphenicol resistance gene. Alternatively, instead of the *E. coli* fadA and fadB genes, the *E. coli* fadI (NP_416844) (shown in FIG. 17 as SEQ ID NO:223) and fadJ (NP_416843) (shown in FIG. 17 as SEQ ID NO:235) genes (or the corresponding orthologs from other organisms) are used. As an alternative to the *E. gracilis* ter gene, the corresponding orthologs from other organisms or the *E. coli* fabI (NP_415804) (shown in FIG. 17 as SEQ ID NO:237) gene are used. Although FabI normally reduces trans-2-enoyl-ACPs, it is also active with trans-2-enoyl-CoAs (Bergler et al., *J. Biol. Chem.* 269:5493-5496 (1993)).

The pACYC-ptrc_fadAB-ter plasmid or the pACYC-ptrc_fadAB-fabI plasmid is cotransformed with the pCL-ptrc_carB-'tesA plasmid (described in Example 4) into an *E. coli* ΔfadE strain. These strains are cultured, extracted and analyzed for fatty alcohol production as described in Example 3. The two different strains produce fatty alcohols with different chain length distribution.

As these strains express 'TesA, a portion of the fatty alcohols produced are derived from malonyl-CoA dependent acyl-ACP precursors. 'TesA efficiently hydrolyzes acyl-ACPs when overexpressed in *E. coli*, although it has higher specific activity for acyl-CoAs as compared to acyl-ACPs. To increase the proportion or exclusively produce fatty alcohols derived from the malonyl-CoA independent pathway, alternative thioesterases that have lower hydrolytic activity towards acyl-ACPs are used instead of 'TesA. One example is *E. coli* TesB (NP_414986), which prefers acyl-CoAs over acyl-ACPs (Spencer et al., *J. Biol. Chem.* 253:5922-5926 (1978)) and when overexpressed in *E. coli* does not hydrolyze acyl ACPs (Zheng et al., *App. Environ. Microbiol.* 70:3807-3813 (2004)). In alternative methods, orthologs of TesA and TesB or thioesterases from other protein families that hydrolyze acyl-CoAs with high efficiency while hydrolyzing acyl-ACPs with low efficiency are used.

In one method, a pCL-ptrc_carB-'tesB plasmid is constructed as described in Example 4 by replacing the 'tesA gene with the tesB gene (NP_414986) (shown in FIG. 17 as SEQ ID NO:239). The plasmid is cotransformed with the pACYC-ptrc_fadAB-ter plasmid or the pACYC-ptrc_fadAB-fabI plasmid into an *E. coli* ΔfadE strain. These strains are cultured, extracted and analyzed for fatty alcohol production as described in Example 3.

In another method, the pCL-ptrc_carB-'tesA plasmid is replaced with a pCL-ptrc_acr1 plasmid, which expresses the acyl-CoA reductase Acr1 from *Acinetobacter baylyi* ADP1 (YP_047869) (shown in FIG. 17 as SEQ ID NO:241). This reductase specifically reduces acyl-CoAs but not acyl-ACPs to the corresponding fatty alcohols (Reiser et al., *J. Bacteriol.* 179:2969-2975 (1997)). The plasmid is cotransformed with the pACYC-ptrc_fadAB-ter plasmid or the pACYC-ptrc_fadAB-fabI plasmid into an *E. coli* ΔfadE strain. These strains are cultured, extracted and analyzed for fatty alcohol production as described in Example 3. The strains produce fatty alcohols independent of malonyl-CoA.

Example 9

Identification of Iron as an Inhibitor of Fatty Alcohol Production

Hu9 medium is a known fermentation medium, which contains 6 g/L $Na_2HPO_4$, 3 g/L $KH_2PO_4$, 0.5 g/L NaCl, 1 g/L $NH_4Cl$, 0.1 mM $CaCl_2$, 1 mM $MgSO_4$, 15 g/L agar, 10 mM glucose, 50 mg/L Uracil, and trace minerals containing 100 µM $FeCl_3$, 500 µM $ZnCl_2$, 200 µM $Na_2Mo_4$, 200 µM $CuSO_4$, 200 µM $H_3BO_3$. However, it was observed that the production of fatty alcohols was completely reduced when recombinant *E. coli* strains, otherwise capable of producing fatty alcohols, were grown in Hu9 medium. As described in detail below, the inability of *E. coli* strains to produce fatty alcohols in various incomplete Hu9 media was measured, and it was found that the recombinant bacteria were incapable of producing fatty alcohols when iron was present in the medium. However, the addition of iron did not inhibit the growth of the bacteria.

In order to identify the component(s) involved in the inhibition of fatty alcohol production, different versions of incomplete Hu9 medium were made, some of which lacked a dispensable ingredient, and then the production of fatty alcohol was evaluated.

In the first step the following media were made: complete Hu9 medium, incomplete Hu9 medium lacking uracil, and incomplete Hu9 medium lacking trace elements. K6 cells (a recombinant bacterial strain C41 (DE3, ΔfadE) carrying pACYCDuet-1-carB, encoding the CAR homolog carB and pETDuet-1-'tesA) were cultured in 2 mL of LB containing appropriate antibiotics. After reaching an OD of 1.0, the 2 mL cultures were scaled up in 125 mL shake flasks (containing one of the Hu9 media described above) to a volume 22 mL. The cultures were induced by adding IPTG to a final concentration of 1 mM. After growing them for 20 hrs at 37° C., 22 mL of ethyl acetate (with 1% of acetic acid, v/v) was added to each flask to extract the fatty alcohols produced during the fermentation. The crude ethyl acetate extract was directly analyzed with GC/MS and the total fatty alcohol titers were quantified.

As depicted in FIG. 14A, the fatty alcohol production was inhibited to a great extent by the addition of trace elements as compared to the addition of uracil to the incomplete Hu9 medium. This indicated that the inhibitory component(s) was a part of trace mineral solution.

In order to find out which trace element was responsible for the fatty alcohol production inhibition, the following Hu9 media were made: complete Hu9 medium; Hu9 lacking $FeCl_3$; Hu9 lacking $ZnCl_2$; Hu9 lacking $Na_2Mo_4$; Hu9 lacking $CuSO_4$; and Hu9 lacking $H_3BO_3$. The fatty alcohol production of $K_6$ cells grown in these different Hu9 media was evaluated using the method described above.

As shown in FIG. 14B, fatty alcohol production was inhibited mainly by the addition of iron to the medium. Thus, by eliminating or reducing the presence of iron (e.g., ferric citrate, ferric chloride, or ferrous sulfate) in the culture medium, fatty alcohols can be produced.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (272 sequences)

SEQ ID NO: 1 - DNA, 29 bp, Artificial Sequence
  Description of Artificial Sequence: Synthetic primer
catatgtcgatcaacgatcagcgactgac

SEQ ID NO: 2 - DNA, 26 bp, Artificial Sequence
  Description of Artificial Sequence: Synthetic primer
cctaggtcacagcagcccgagcagtc

SEQ ID NO: 3 - DNA, 20 bp, Artificial Sequence
  Description of Artificial Sequence: Synthetic primer
catatgacgatcgaaacgcg

SEQ ID NO: 4 - DNA, 26 bp, Artificial Sequence
  Description of Artificial Sequence: Synthetic primer
cctaggttacagcaatccgagcatct

SEQ ID NO: 5 - DNA, 21 bp, Artificial Sequence
  Description of Artificial Sequence: Synthetic primer
catatgaccagcgatgttcac

SEQ ID NO: 6 - DNA, 27 bp, Artificial Sequence
  Description of Artificial Sequence: Synthetic primer
cctaggtcagatcagaccgaactcacg

SEQ ID NO: 7 - protein, 7 aa, Artificial Sequence
  Description of Artificial Sequence: Synthetic peptide
  MOD_RES (3)..(4): Any amino acid
  MOD_RES (5)..(5): Ser, Ala or Thr
  MOD_RES (7)..(7): Trp or Leu
GYXXXKX

SEQ ID NO: 8 - protein, 7 aa, Artificial Sequence
  Description of Artificial Sequence: Synthetic peptide
  MOD_RES (2)..(3): Any amino acid
  MOD_RES (5)..(5): Any amino acid
GXXGXLG

SEQ ID NO: 9 - protein, 8 aa, Artificial Sequence
  Description of Artificial Sequence: Synthetic peptide
  MOD_RES (1)..(1): Leu, Val or Ile
  MOD_RES (6)..(7): Any amino acid
XGGDSXXA

SEQ ID NO: 10 - protein, 12 aa, Artificial Sequence
  Description of Artificial Sequence: Synthetic peptide
  MOD_RES (1)..(1): Leu, Ile, Val, Met, Phe or Tyr
  MOD_RES (2)..(2): Any amino acid except Glu
  MOD_RES (3)..(3): Any amino acid except Val, Glu or Ser
  MOD_RES (4)..(4): Ser, Thr or Gly
  MOD_RES (5)..(5): Ser, Thr, Ala or Gly
  MOD_RES (7)..(7): Ser or Thr
  MOD_RES (8)..(8): Ser, Thr, Glu, Ile or Ala
  MOD_RES (9)..(9): Ser or Gly
  MOD_RES (10)..(10): Any amino acid
  MOD_RES (11)..(11): Pro, Ala, Ser, Leu, Ile, Val or Met
  MOD_RES (12)..(12): Lys or Arg
XXXXXGXXXXXX

SEQ ID NO: 11 - protein, 21 aa, Artificial Sequence
  Description of Artificial Sequence: Synthetic peptide
  MOD_RES (6)..(6): Ser or Thr
  MOD_RES (9)..(9): Thr or Asn
  MOD_RES (11)..(11): Phe or Trp
  MOD_RES (15)..(15): Phe or Tyr
  MOD_RES (17)..(17): Ala or Thr
  MOD_RES (19)..(19): Glu or Gln
RTVLLXGAXGXLGRXLXLXWL

SEQ ID NO: 12 - protein, 20 aa, Artificial Sequence
  Description of Artificial Sequence: Synthetic peptide
  MOD_RES (2)..(3): Any amino acid
  MOD_RES (5)..(6): Any amino acid
  MOD_RES (8)..(8): Any amino acid
  MOD_RES (11)..(12): Any amino acid
  MOD_RES (14)..(14): Any amino acid
  MOD_RES (16)..(16): Any amino acid
  MOD_RES (19)..(19): Any amino acid
LXXGXXGXLGXXLXLXWLXR

SEQ ID NO: 13 - protein, 8 aa, Artificial Sequence
  Description of Artificial Sequence: Synthetic peptide
  MOD_RES (3)..(3): Any amino acid
WAXEVLLR

SEQ ID NO: 14 - protein, 33 aa, Artificial Sequence
  Description of Artificial Sequence: Synthetic polypeptide
  MOD_RES (2)..(3): Any amino acid
  MOD_RES (5)..(6): Any amino acid
  MOD_RES (8)..(8): Any amino acid
  MOD_RES (11)..(12): Any amino acid
  MOD_RES (14)..(14): Any amino acid
  MOD_RES (15)..(15): Leu or Ile
  MOD_RES (16)..(16): Any amino acid
  MOD_RES (17)..(17): Trp or Leu
  MOD_RES (19)..(32): Any amino acid and this region may be 13 to 14 residues in length
LXXGXXGXLGXXLXXXXLXXXXXXXXXXXXXXR

SEQ ID NO: 15 - DNA, 3525 bp, Nocardia sp.
atggcagtggattcaccggatgagcggctacagcgccgcattgcacagttgtttgcagaagatgagcaggtcaaggccgcacgtccgctcgaagcggtgagcgcggcggtgagcgcgcccggtatgcggctggcgcagatcgccgccactgttatggcgggttacgccgaccgcccggccgccgggcagcgtgcgttcgaactgaacaccgacgacgcgacgggccgcacctcgctgcggttacttccccgattcgagaccatcacctatcgcgaactgtggcagcgagtcggcgaggttgccgcggcctggcatcatgatcccgagaaccccttgcgcgcaggtgatttcgtcgccctgctcggcttcaccagcatcgactacgccaccctcgacctggccgatatccacctcggcgcggttaccgtgccgttgcaggccagcgcggcggtgtcccagctgatcgctatcctcaccgagacttcgccgcggctgctcgcctcgaccccggagcacctcgatgcggcggtcgagtgcctactcgcgggcaccacaccggaacgactggtggtcttcgactaccaccccgaggacgacgaccagcgtgcggccttcgaatccgcccgccgccgccttgccgacgcgggcagcttggtgatcgtcgaaacgctcgatgccgtgcgtgcccggggccgcgacttaccggccgcgccactgttcgttcccgacaccgacgacgacccgctggccctgctgatctacacctccggcagcaccggaacgccgaagggcgcgatgtacaccaatcggttggccgccacgatgtggcaggggaactcgatgctgcaggggaactcgcaacgggtcgggatcaatctcaactacatgccgatgagccacatcgccggtcgcatatcgctgttcggcgtgctcgctcgcggtggcaccgcatacttcgcggccaagagcgacatgtcgacactgttcgaagacatcggcttggtacgtcccaccgagatcttcttcgtcccgcgcgtgtgcgacatggtcttccagcgctatcagagcgagctggaccggcgctcggtggcgggcgccgacctggacacgctcgatcgggaagtgaaagccgacctccggcagaactacctcggtgggcgcttcctggtggcggtcgtcggcagcgcgccgctggccgcggagatgaagacgttcatggagtccgtcctcgatctgccactgcacgacgggtacgggtcgaccgaggcgggcgcaagcgtgctgctcgacaaccagatccagcggccgccggtgctcgattacaagctcgtcgacgtgcccgaactgggttacttccgcaccgaccggccgcatccgcgcggtgagctgttgttgaaggcggagaccacgattccgggctactacaagcggcccgaggtcaccgcggagatcttcgacgaggacggcttctacaagaccggcgatatcgtggccgagctcgagcacgatcggctggtctatgtcgaccgtcgcaacaatgtgctcaaactgtcgcagggcgagttcgtgaccgtcgcccatctcgaggccgtgttcgccagcagcccgctgatccggcagatcttcatctacggcagcagcgaacgttcctatctgctcgcggtgatcgtccccaccgacgacgcgctgcgcggccgcgacaccgccaccttgaaatcggcactggccgaatcgattcagcgcatcgccaaggacgcgaacctgcagccctacgagattccgcgcgatttcctgatcgagaccgagccgttcaccatcgccaacggactgctctccggcatcgcgaagctgctgcgccccaatctgaaggaacgctacggcgctcagctggagcagatgtacaccgatctcgcgacaggccaggccgatgagctgctcgccctgcgccgcgaagccgccgacctgccggtgctcgaaaccgtcagccgggcagcgaaagcgatgctcggcgtcgcctccgccgatatgcgtcccgacgcgcacttcaccgacctgggcggcgattccctttccgcgctgtcgttctcgaacctgctgcacgagatcttcggggtcgaggtgccggtgggtgtcgtcgtcagcccggcgaacgagctgcgcgatctggcgaattacattgaggcggaacgcaactcgggcgcgaagcgtcccaccttcacctcggtgcacggcggcggttccgagatccgcgccgccgatctgaccctcgacaagttcatcgatgcccgcaccctggccgccgccgacagcattccgcacgcgccggtgccagcgcagacggtgctgctgaccggcgcgaacggctacctcggccggttcctgtgcctggaatggctggagcggctggacaagacgggtggcacgctgatctgcgtcgtgcgcggtagtgacgcggccgcggcccgtaaacggctggactcggcgttcgacagcggcgatcccggcctgctcgagcactaccagcaactggccgcacggaccctggaagtcctcgccggtgatatcggcgacccgaatctcggtctggacgacgcgacttggcagcggttggccgaaaccgtcgacctgatcgtccatcccgccgcgttggtcaaccacgtccttccctacacccagctgttcggccccaatgtcgtcggcaccgccgaaatcgtccggttggcgatcacggcgcggcgcaagccggtcacctacctgtcgaccgtcggagtggccgaccaggtcgacccggcggagtatcaggaggacagcgacgtccgcgagatgagcgcggtgcgcgtcgtgcgcgagagttacgccaacggctacggcaacagcaagtgggcgggggaggtcctgctgcgcgaagcacacgatctgtgtggcttgccggtcgcggtgttccgttcggacatgatcctggcgcacagccggtacgcgggtcagctcaacgtccaggacgtgttcacccggctgatcctcagcctggtcgccaccggcatcgcgccgtactcgttctaccgaaccgacgcggacggcaaccggcagcgggcccactatgacggcttgccggcggacttcacggcggcggcgatcaccgcgctcggcatccaagccaccgaaggcttccggacctacgacgtgctcaatccgtacgacgatggcatctccctcgatgaattcgtcgactggctcgtcgaatccggccacccgatccagcgcatcaccgactacagcgactggttccaccgtttcgagacggcgatccgcgcgctgccggaaaagcaacgccaggcctcggtgctgccgttgctggacgcctaccgcaacccctgcccggcggtccgcggcgcgatactcccggccaaggagttccaagcggcggtgcaaacagccaaaatcggtccggaacaggacatcccgcatttgtccgcgccactgatcgataagtacgtcagcgatctggaactgcttcagctgctctga

SEQ ID NO: 16 - protein, 1174 aa, Nocardia sp.
MAVDSPDERLQRRIAQLFAEDEQVKAARPLEAVSAAVSAPGMRLAQIAATVMAGYADRPAAGQRAFELNTDDATGRTSLRLLPRFETITYRELWQRVGEVAAAWHHDPENPLRAGDFVALLGFTSIDYATLDLADIHLGAVTVPLQASAAVSQLIAILTETSPRLLASTPEHLDAAVECLLAGTTPERLVVFDYHPEDDDQRAAFESARRRLADAGSLVIVETLDAVRARGRDLPAAPLFVPDTDDDPLALLIYTSGSTGTPKGAMYTNRLAATMWQGNSMLQGNSQRVGINLNYMPMSHIAGRISLFGVLARGGTAYFAAKSDMSTLFEDIGLVRPTEIFFVPRVCDMVFQRYQSELDRRSVAGADLDTLDREVKADLRQNYLGGRFLVAVVGSAPLAAEMKTFMESVLDLPLHDGYGSTEAGASVLLDNQIQRPPVLDYKLVDVPELGYFRTDRPHPRGELLLKAETTIPGYYKRPEVTAEIFDEDGFYKTGDIVAELEHDRLVYVDRRNNVLKLSQGEFVTVAHLEAVFASSPLIRQIFIYGSSERSYLLAVIVPTDDALRGRDTATLKSALAESIQRIAKDANLQPYEIPRDFLIETEPFTIANGLLSGIAKLLRPNLKERYGAQLEQMYTDLATGQADELLALRREAADLPVLETVSRAAKAMLGVASADMRPDAHFTDLGGDSLSALSFSNLLHEIFGVEVPVGVVVSPANELRDLANYIEAERNSGAKRPTFTSVHGGGSEIRAADLTLDKFIDARTLAAADSIPHAPVPAQTVLLTGANGYLGRFLCLEWLERLDKTGGTLICVVRGSDAAAARKRLDSAFDSGDPGLLEHYQQLAARTLEVLAGDIGDPNLGLDDATWQRLAETVDLIVHPAALVNHVLPYTQLFGPNVVGTAEIVRLAITARRKPVTYLSTVGVADQVDPAEYQEDSDVREMSAVRVVRESYANGYGNSKWAGEVLLREAHDLCGLPVAVFRSDMILAHSRYAGQLNVQDVFTRLILSLVATGIAPYSFYRTDADGNRQRAHYDGLPADFTAAAITALGIQATEGFRTYDVLNPYDDGISLDEFVDWLVESGHPIQRITDYSDWFHRFETAIRALPEKQRQASVLPLLDAYRNPCPAVRGAILPAKEFQAAVQTAKIGPEQDIPHLSAPLIDKYVSDLELLQLL

SEQ ID NO: 17 - DNA, 3507 bp, Mycobacterium tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 18 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 19 - DNA, 3507 bp, Mycobacterium smegmatis
ttacagcaatccgagcatctgcaggttgctgatgtacttgacgatcacgtcggccgtgacgtgcggaatgtccttgtcggggccgatcttcgcgtcctgcaccgcggcacggaaccggtcggtgggtgccatggcaccgcacacgggcggtgagggctgctgatagttgtgcagcagcggcagcagcgaggcctgacgttgccgttccggcagggcccgcagtgcggtttcgaaccggctcagccaggtggcgtagtcgtcgacgcggtgcacggggtagccggcctcgatcagccagtccacgtactcgtcgaggccgatgccgtcgtcgtacgggttcatcacgtggaacgtctcgaatccgtcggtgacctgcgagccgatggtggagatcgcctcggcgatgaactccacgggcagcccgtcgtagtgggcgcgctgccggttgccgtccgcatcgagttcgtagaacgaaccgggcgcgatgccggtcgccacgaggctcagcatcaggcgggtgaacatgtccggcaggttcagctgacccgagtaggtcgtgtcggccaggatcatgtcgcagcggaacaccgagaccggcagaccacaccagtcgtgcgcctcccgcagcaggacctcgccggcccacttgctgttgccgtagccgttggcgtacgagtcgtcgacccggcgcgtcgcgctgatctcgcggatgtcggcgtcctcgacgaacgcctcgggggagatgccctgtcccacaccgatcgtcgagacgtacacgtacggcttgatcgtggtggtcagcgcgatccggatgagttcggcggtgccgagcgcattgggtccgaacatctggctgtacggcaggacgtgattgaccagggcggccggatcgacgatcagatcgacggtgtcggccagtcgctgccacgtgtcgtggtcgagacccagatcggcctcgcccttgtcaccggcgatcacctcgaggtgatcggctgccagcgcgcggtagtgctcgagcagtgtcgcgtccccggtgtcgaacgtggcgtccagacgcgcccgggcctcgtcgtcgctgcgggcgcgcaccaggcagatcaccttgccgtccaccaggtccatgcgctccagccattccagcgccagatagcggcccaggaacccggtggcgccggtcagcagcacggtgcggatctcggtgcccgaacgcggcagacccggcgcggcggacagggtcttggcgtcgatgaacttgcccagggcgagatcacgcgcgcgcacctcggtggcgtcgcgcccgtgcaccgacgcgtatgtggggcgcttggagccgcgcagttcgccctcgatgtaggccgcgacgcctgccaggtcggtggccgggctgacgatgacgccgaccggcacgtcgacatcgaagatctcgtgcaacaggttcgagaagctcaaggccgacaacgaatctccacccagatcggtgaagtgcgcatcggaccgcagatccgtgacggaggcaccgagcagtgcgaccgcggcgcggctgacggtctcgaccacgggccggtcggctccgttgcggcgcaactcgcgcaactcgttggcctgcccctcggccaggtcggtgtagagctgttcgaggcgttcgccgtagtgcgccttcagtttcggccgggccagcttgcggataccggtcagcaggccgttctccagcgtgaaaggtgttgtctcgacgaggaagtcacgcgggatctcatacgactgcaatccggcggctcgtgccgcgtcctgcagtgagtcgctgatgcgcgacttgagttcgtcaccgtcccaacgtgacagtgcctcttcggtcgggaccacgaccgccagcagataggaccgcgcgctgttgccgtagacgtagatctggcgtaccagggggctgtcgccgaacaccgcctccagcttggagaccgtgacgaattcgccctgcgacagtttcagcacgttgttgcggcggtcgaggtattcgagatggtcgggcccgagctcggcgacgatgtcgccggtgcggtagtacccgtcctcgtcgaacatctcggcggtgatctccggacgcttgtagtagccggggaacatctgctcggacttgaccagaagttcgccgcgcgggtagggccggtccgtggcgaagtagccgagatcgggcacgtcgaccagcttgtagtcgatgaccggcgggcgctggatctgcccgtcgatgaacaccgcgccggcctcggtggagccgtagccctccagcagatgcatgtcgagcaggtcctcgacccagctcttcatctccgccgagatgggagccgatccggtcagggccgaaacgaatcgcccgccgagcagttgggtgcggacctcttcgaggactgcggcttcggctcggtcctcggatccctcggcgcggcggttgtcgaggcggctctggtactcctggaacagcatgtcccagatgcgaggaacgaagttgagctgcgtgggccgcacgagggcgaggtcctccaggaaggtggacaggtcgctgcgtgcggcgaagtacgcggttccgccgctggcgagtgtgctgcacaggatgccgcgccccatgacgtgactcatgggcatgaagttcagggtgatcgacggcatcacgccgagggtctcgtcccaccgggccttggacccggcctgccacatcgtggcggtcttggactcggggtacatcgcgcccttgggagtgccggtgctgccggaggtgtagatgagaagggtcagcgggtcggcctcgtcgggcacgtagagcggtgcgtcggcgagtgaccgcccgcggtccagtgcgtcggtgatcgtctcgacgacgacgccggtgcctgcgagcttgcccttggccgcctcgaacgcctcacgctgatcgtcgacctcgtggctgtagtcgaacaccaccagtcgcgacggcgcgggcccggactcgacgagagcgactgcgtcggcgaggaagtcgacgctcgacgcgatcaccttgggctcggtctcggcgacgatcggctgcagttgggccaccggcgcactggtctgcagcggtacggacacggcgccgagttcgagcagggcgatgtcgatcgtcgtgtagtcgacactggtgaaacccaggatggccacgcggtcaccggcattcaccggatggttgtgccaggcattggtcacggcctggatccggcctgcgagctgacggtaggtgatggtgtcgaagcggggcaggagcttcgcggtggtgcggccttcttcgtcggtgacgaactcgacggcgcgcttgcccagcgcagggcggtccgcatagccggccagaatctgtttgaccgcggcaggaaggcgcaactccggatcggcggcagccgcgctgatcgcctcgtcgggacgggcggcggcgaactgcgggtcggtttcgaacaagtggtcaatgcgccggttgaagcggtcttcgcgcgtttcgatcgtcat

SEQ ID NO: 20 - protein, 1168 aa, Mycobacterium smegmatis
MTIETREDRFNRRIDHLFETDPQFAAARPDEAISAAAADPELRLPAAVKQILAGYADRPALGKRAVEFVTDEEGRTTAKLLPRFDTITYRQLAGRIQAVTNAWHNHPVNAGDRVAILGFTSVDYTTIDIALLELGAVSVPLQTSAPVAQLQPIVAETEPKVIASSVDFLADAVALVESGPAPSRLVVFDYSHEVDDQREAFEAAKGKLAGTGVVVETITDALDRGRSLADAPLYVPDEADPLTLLIYTSGSTGTPKGAMYPESKTATMWQAGSKARWDETLGVMPSITLNFMPMSHVMGRGILCSTLASGGTAYFAARSDLSTFLEDLALVRPTQLNFVPRIWDMLFQEYQSRLDNRRAEGSEDRAEAAVLEEVRTQLLGGRFVSALTGSAPISAEMKSWVEDLLDMHLLEGYGSTEAGAVFIDGQIQRPPVIDYKLVDVPDLGYFATDRPYPRGELLVKSEQMFPGYYKRPEITAEMFDEDGYYRTGDIVAELGPDHLEYLDRRNNVLKLSQGEFVTVSKLEAVFGDSPLVRQIYVYGNSARSYLLAVVVPTEEALSRWDGDELKSRISDSLQDAARAAGLQSYEIPRDFLVETTPFTLENGLLTGIRKLARPKLKAHYGERLEQLYTDLAEGQANELRELRRNGADRPVVETVSRAAVALLGASVTDLRSDAHFTDLGGDSLSALSFSNLLHEIFDVDVPVGVIVSPATDLAGVAAYIEGELRGSKRPTYASVHGRDATEVRARDLALGKFIDAKTLSAAPGLPRSGTEIRTVLLTGATGFLGRYLALEWLERMDLVDGKVICLVRARSDDEARARLDATFDTGDATLLEHYRALAADHLEVIAGDKGEADLGLDHDTWQRLADTVDLIVDPAALVNHVLPYSQMFGPNALGTAELIRIALTTTIKPYVYVSTIGVGQGISPEAFVEDADIREISATRRVDDSYANGYGNSKWAGEVLLREAHDWCGLPVSVFRCDMILADTTYSGQLNLPDMFTRLMLSLVATGIAPGSFYELDADGNRQRAHYDGLPVEFIAEAISTIGSQVTDGFETFHVMNPYDDGIGLDEYVDWLIEAGYPVHRVDDYATWLSRFETALRALPERQRQASLLPLLHNYQQPSPPVCGAMAPTDRFRAAVQDAKIGPDKDIPHVTADVIVKYISNLQMLGLL

SEQ ID NO: 21 - DNA, 3522 bp, Mycobacterium smegmatis
atgaccagcgatgttcacgacgccacagacggcgtcaccgaaaccgcactcgacgacgagcagtcgacccgccgcatcgccgagctgtacgccaccgatcccgagttcgccgccgccgcaccgttgcccgccgtggtcgacgcggcgcacaaacccgggctgcggctggcagagatcctgcagaccctgttcaccggctacggtgaccgcccggcgctgggataccgcgcccgtgaactggccaccgacgagggcgggcgcaccgtgacgcgtctgctgccgcggttcgacaccctcacctacgcccaggtgtggtcgcgcgtgcaagcggtcgccgcggccctgcgccacaacttcgcgcagccgatctaccccggcgacgccgtcgcgacgatcggtttcgcgagtcccgattacctgacgctggatctcgtatgcgcctacctgggcctcgtgagtgttccgctgcagcacaacgcaccggtcagccggctcgccccgatcctggccgaggtcgaaccgcggatcctcaccgtgagcgccgaatacctcgacctcgcagtcgaatccgtgcgggacgtcaactcggtgtcgcagctcgtggtgttcgaccatcaccccgaggtcgacgaccaccgcgacgcactggcccgcgcgcgtgaacaactcgccggcaagggcatcgccgtcaccaccctggacgcgatcgccgacgagggcgccgggctgccggccgaaccgatctacaccgccgaccatgatcagcgcctcgcgatgatcctgtacacctcgggttccaccggcgcacccaagggtgcgatgtacaccgaggcgatggtggcgcggctgtggaccatgtcgttcatcacgggtgaccccacgccggtcatcaacgtcaacttcatgccgctcaaccacctgggcgggcgcatccccatttccaccgccgtgcagaacggtggaaccagttacttcgtaccggaatccgacatgtccacgctgttcgaggatctcgcgctggtgcgcccgaccgaactcggcctggttccgcgcgtcgccgacatgctctaccagcaccacctcgccaccgtcgaccgcctggtcacgcagggcgccgacgaactgaccgccgagaagcaggccggtgccgaactgcgtgagcaggtgctcggcggacgcgtgatcaccggattcgtcagcaccgcaccgctggccgcggagatgagggcgttcctcgacatcaccctgggcgcacacatcgtcgacggctacgggctcaccgagaccggcgccgtgacacgcgacggtgtgatcgtgcggccaccggtgatcgactacaagctgatcgacgttcccgaactcggctacttcagcaccgacaagccctacccgcgtggcgaactgctggtcaggtcgcaaacgctgactcccgggtactacaagcgccccgaggtcaccgcgagcgtcttcgaccgggacggctactaccacaccggcgacgtcatggccgagaccgcacccgaccacctggtgtacgtggaccgtcgcaacaacgtcctcaaactcgcgcagggcgagttcgtggcggtcgccaacctggaggcggtgttctccggcgcggcgctggtgcgccagatcttcgtgtacggcaacagcgagcgcagtttccttctggccgtggtggtcccgacgccggaggcgctcgagcagtacgatccggccgcgctcaaggccgcgctggccgactcgctgcagcgcaccgcacgcgacgccgaactgcaatcctacgaggtgccggccgatttcatcgtcgagaccgagccgttcagcgccgccaacgggctgctgtcgggtgtcggaaaactgctgcggcccaacctcaaagaccgctacgggcagcgcctggagcagatgtacgccgatatcgcggccacgcaggccaaccagttgcgcgaactgcggcgcgcggccgccacacaaccggtgatcgacaccctcacccaggccgctgccacgatcctcggcaccgggagcgaggtggcatccgacgcccacttcaccgacctgggcggggattccctgtcggcgctgacactttcgaacctgctgagcgatttcttcggtttcgaagttcccgtcggcaccatcgtgaacccggccaccaacctcgcccaactcgcccagcacatcgaggcgcagcgcaccgcgggtgaccgcaggccgagtttcaccaccgtgcacggcgcggacgccaccgagatccgggcgagtgagctgaccctggacaagttcatcgacgccgaaacgctccgggccgcaccgggtctgcccaaggtcaccaccgagccacggacggtgttgctctcgggcgccaacggctggctgggccggttcctcacgttgcagtggctggaacgcctggcacctgtcggcggcaccctcatcacgatcgtgcggggccgcgacgacgccgcggcccgcgcacggctgacccaggcctacgacaccgatcccgagttgtcccgccgcttcgccgagctggccgaccgccacctgcgggtggtcgccggtgacatcggcgacccgaatctgggcctcacacccgagatctggcaccggctcgccgccgaggtcgacctggtggtgcatccggcagcgctggtcaaccacgtgctcccctaccggcagctgttcggccccaacgtcgtgggcacggccgaggtgatcaagctggccctcaccgaacggatcaagcccgtcacgtacctgtccaccgtgtcggtggccatggggatccccgacttcgaggaggacggcgacatccggaccgtgagcccggtgcgcccgctcgacggcggatacgccaacggctacggcaacagcaagtgggccggcgaggtgctgctgcgggaggcccacgatctgtgcgggctgcccgtggcgacgttccgctcggacatgatcctggcgcatccgcgctaccgcggtcaggtcaacgtgccagacatgttcacgcgactcctgttgagcctcttgatcaccggcgtcgcgccgcggtcgttctacatcggagacggtgagcgcccgcgggcgcactaccccggcctgacggtcgatttcgtggccgaggcggtcacgacgctcggcgcgcagcagcgcgagggatacgtgtcctacgacgtgatgaacccgcacgacgacgggatctccctggatgtgttcgtggactggctgatccgggcgggccatccgatcgaccgggtcgacgactacgacgactgggtgcgtcggttcgagaccgcgttgaccgcgcttcccgagaagcgccgcgcacagaccgtactgccgctgctgcacgcgttccgcgctccgcaggcaccgttgcgcggcgcacccgaacccacggaggtgttccacgccgcggtgcgcaccgcgaaggtgggcccgggagacatcccgcacctcgacgaggcgctgatcgacaagtacatacgcgatctgcgtgagttcggtctgatctga

SEQ ID NO: 22 - protein, 1173 aa, Mycobacterium smegmatis
MTSDVHDATDGVTETALDDEQSTRRIAELYATDPEFAAAAPLPAVVDAAHKPGLRLAEILQTLFTGYGDRPALGYRARELATDEGGRTVTRLLPRFDTLTYAQVWSRVQAVAAALRHNFAQPIYPGDAVATIGFASPDYLTLDLVCAYLGLVSVPLQHNAPVSRLAPILAEVEPRILTVSAEYLDLAVESVRDVNSVSQLVVFDHHPEVDDHRDALARAREQLAGKGIAVTTLDAIADEGAGLPAEPIYTADHDQRLAMILYTSGSTGAPKGAMYTEAMVARLWTMSFITGDPTPVINVNFMPLNHLGGRIPISTAVQNGGTSYFVPESDMSTLFEDLALVRPTELGLVPRVADMLYQHHLATVDRLVTQGADELTAEKQAGAELREQVLGGRVITGFVSTAPLAAEMRAFLDITLGAHIVDGYGLTETGAVTRDGVIVRPPVIDYKLIDVPELGYFSTDKPYPRGELLVRSQTLTPGYYKRPEVTASVFDRDGYYHTGDVMAETAPDHLVYVDRRNNVLKLAQGEFVAVANLEAVFSGAALVRQIFVYGNSERSFLLAVVVPTPEALEQYDPAALKAALADSLQRTARDAELQSYEVPADFIVETEPFSAANGLLSGVGKLLRPNLKDRYGQRLEQMYADIAATQANQLRELRRAAATQPVIDTLTQAAATILGTGSEVASDAHFTDLGGDSLSALTLSNLLSDFFGFEVPVGTIVNPATNLAQLAQHIEAQRTAGDRRPSFTTVHGADATEIRASELTLDKFIDAETLRAAPGLPKVTTEPRTVLLSGANGWLGRFLTLQWLERLAPVGGTLITIVRGRDDAAARARLTQAYDTDPELSRRFAELADRHLRVVAGDIGDPNLGLTPEIWHRLAAEVDLVVHPAALVNHVLPYRQLFGPNVVGTAEVIKLALTERIKPVTYLSTVSVAMGIPDFEEDGDIRTVSPVRPLDGGYANGYGNSKWAGEVLLREAHDLCGLPVATFRSDMILAHPRYRGQVNVPDMFTRLLLSLLITGVAPRSFYIGDGERPRAHYPGLTVDFVAEAVTTLGAQQREGYVSYDVMNPHDDGISLDVFVDWLIRAGHPIDRVDDYDDWVRRFETALTALPEKRRAQTVLPLLHAFRAPQAPLRGAPEPTEVFHAAVRTAKVGPGDIPHLDEALIDKYIRDLREFGLI

SEQ ID NO: 23 - DNA, 3525 bp, Mycobacterium ulcerans
atgtcgccaatcacgcgtgaagagcggctcgagcgccgcatccaggacctctacgccaacgacccgcagttcgccgccgccaaacccgtcacggcgatcaccgcagcaatcgagcggccgggtctaccgctaccccagatcatcgagaccgtcatgaccggatacgccgatcggccggctctcgctcagcgctcggtcgaattcgtgaccgatgccggcaccggccacaccacgctgcgactgctcccccacttcgaaaccatcagctacggcgagctttgggaccgcatcagcgcactggccgacgtgctcagcaccgaacagacggtgaaaccgagcgaccgggtctgcttgttgggcttcaacagcgtcgactacgccacgatcgacatgactttggcgcggctgggcgcggtggctgtaccactgcagaccagcgcggcgataacccagctgcagccgatcgtcgccgagacccagcccaccatgatcgcggccagcgtcgacgcactcgctgacgccaccgaattggctctgtccggtcagaccgctacccgagtcctggtgttcgaccaccaccggcaggttgacgcacaccgcgcagcggtcgaatccgcccgggagcgcctggctggctcggcggtcgtcgaaaccctggccgaggccatcgcgcgcggcgacgtgccccgcggtgcgtccgccggctcggcgcccggcaccgatgtgtccgacgactcgctcgcgctactgatctacacctcgggcagcaccggtgcgcccaagggcgcgatgtacccccgacgcaacgttgcgaccttctggcgcaagcgcacctggttcgaaggcggctacgagccgtcgatcacgctgaacttcatgccaatgagccacgtcatgggccgccaaatcctgtacggcacgctgtgcaatggcggcaccgcctacttcgtggtgaaaagcgatctctccaccttgttcgaagacctggcgctggtgcggcccaccgagctgaccttcgtgccgcgcgtgtgggacatggtgttcgacgagtttcagagtgaggtcgaccgccgcctggtcgacggcgccgaccgggtcgcgctcgaagcccaggtcaaggccgagatacgcaacgacgtgctcggtggacggtataccagcgcactgaccggctccgccccgatctccgacgagatgaaggcgtgggtcgaggagctgctcgacatgcatctggtcgagggctacggctccaccgaggccgggatgatcctgatcgacggagccattcggcgcccggcggtactcgactacaagctggtcgatgttcccgacctgggttacttcctgaccgaccggccacatccgcggggcgagttgctggtcaagaccgatagtttgttcccgggctactaccagcgagccgaagtcaccgccgacgtgttcgatgctgacggcttctaccggaccggcgacatcatggccgaggtcggccccgaacagttcgtgtacctcgaccgccgcaacaacgtgttgaagctgtcgcagggcgagttcgtcaccgtctccaaactcgaagcggtgtttggcgacagcccactggtacggcagatctacatctacggcaacagcgcccgtgcctacctgttggcggtgatcgtccccacccaggaggcgctggacgccgtgcctgtcgaggagctcaaggcgcggctgggcgactcgctgcaagaggtcgcaaaggccgccggcctgcagtcctacgagatcccgcgcgacttcatcatcgaaacaacaccatggacgctgcagaacggcctgctcaccggcatccgcaagttggccaggccgcagctgaaaaagcattacggcgagcttctcgagcagatctacacggacctggcacacggccaggccgacgaactgcgctcgctgcgccaaagcggtgccgatgcgccggtgctggtgacggtgtgccgcgcggcggccgcgctgttgggcggcagcgcctctgacgtccagcccgatgcgcacttcaccgatttgggcggcgactcgctgtcggcgctgtcgttcaccaacctgctgcacgagatcttcgacatcgatgtgccggtgggcgtcatcgtcagccccgccaacgacttgcaggccctggccgactacgtcgaggcggctcgcaaacccggctcgtcacgaccgaccttcgcctcggtccacggcgcctcgaatgagcaggtcaccgaggtgcatgccggtgacctgtccctggacaaattcatcgatgccgcaaccctggccgaagctccccggctgcccgccgcaaacacccaagtgcgcaccgtgctgctgaccggcgccaccggcttcctcgggcgctacctggccctggaatggctggagcggatggacctggtcgacggcaaactgatctgcctggtccgggccaagtccgacaccgaagcacgggcgcggctggaaaagacgttcgacagcggcgcccccgaactgctggcccactaccgcgcactggccggcgaccacctcgaggtgctcgccggtgacaagggcgaagccgacctcggactggaccggcagacctggcaacgcctggccgacacggtcgacctgatcgtggaccccgcggccctggtcaaccacgtactgccatacagccagctgttcgggcccaacgcgctgggcaccgccgagctgctgcggctcgcgctcacctccaagatcaagccctacagctacacctcgacaatcggtgtcgccgaccagatcccgccgtcggcgttcaccgaggacgccgacatccgggtcatcagcgccacccgcgcggtcgacgacagctacgccaatggctattcgaacagcaagtgggccggcgaggtgctgttgcgcgaggcgcatgtcctgtgtggcctgccggttgcggtgttccgctgcgacatgatcctggccgacaccacatgggcgggacagctcaacgtgccggacatgttcacccgtatgatcctgagcctggcggccaccggtatcgcgccgggttcgttctatgagcttgcggccgacggcgcccggcaacgcgcccactatgacggtctgcccgtcgagttcatcgccgaggcgatttcgactttgggtgcgcagagccaggatgggttccacacgtatcacgtgatgaacccttacgacgacggcatcggactcgacgagttcgtcgactggctcaacgagtccggttgccccatccagcgcatcgctgactatggcgactggctgcagcgcttcgaaaccgcactgcgcgcactgcccgatcggcagcggcacagctcactgctgccgctgttgcacaactatcggcagccggagcggcccgtccgcgggtcgatcgcccctaccgatcgcttccgggcagcggtgcaagaggccaagatcggccccgacaaagacattccgcacgtcggcgcgccgatcatcgtgaagtacgtcagcgacctgcgcctactcggcctgctctga

SEQ ID NO: 24 - protein, 1174 aa, Mycobacterium ulcerans
MSPITREERLERRIQDLYANDPQFAAAKPVTAITAAIERPGLPLPQIIETVMTGYADRPALAQRSVEFVTDAGTGHTTLRLLPHFETISYGELWDRISALADVLSTEQTVKPSDRVCLLGFNSVDYATIDMTLARLGAVAVPLQTSAAITQLQPIVAETQPTMIAASVDALADATELALSGQTATRVLVFDHHRQVDAHRAAVESARERLAGSAVVETLAEAIARGDVPRGASAGSAPGTDVSDDSLALLIYTSGSTGAPKGAMYPRRNVATFWRKRTWFEGGYEPSITLNFMPMSHVMGRQILYGTLCNGGTAYFVVKSDLSTLFEDLALVRPTELTFVPRVWDMVFDEFQSEVDRRLVDGADRVALEAQVKAEIRNDVLGGRYTSALTGSAPISDEMKAWVEELLDMHLVEGYGSTEAGMILIDGAIRRPAVLDYKLVDVPDLGYFLTDRPHPRGELLVKTDSLFPGYYQRAEVTADVFDADGFYRTGDIMAEVGPEQFVYLDRRNNVLKLSQGEFVTVSKLEAVFGDSPLVRQIYIYGNSARAYLLAVIVPTQEALDAVPVEELKARLGDSLQEVAKAAGLQSYEIPRDFIIETTPWTLQNGLLTGIRKLARPQLKKHYGELLEQIYTDLAHGQADELRSLRQSGADAPVLVTVCRAAAALLGGSASDVQPDAHFTDLGGDSLSALSFTNLLHEIFDIDVPVGVIVSPANDLQALADYVEAARKPGSSRPTFASVHGASNEQVTEVHAGDLSLDKFIDAATLAEAPRLPAANTQVRTVLLTGATGFLGRYLALEWLERMDLVDGKLICLVRAKSDTEARARLEKTFDSGAPELLAHYRALAGDHLEVLAGDKGEADLGLDRQTWQRLADTVDLIVDPAALVNHVLPYSQLFGPNALGTAELLRLALTSKIKPYSYTSTIGVADQIPPSAFTEDADIRVISATRAVDDSYANGYSNSKWAGEVLLREAHVLCGLPVAVFRCDMILADTTWAGQLNVPDMFTRMILSLAATGIAPGSFYELAADGARQRAHYDGLPVEFIAEAISTLGAQSQDGFHTYHVMNPYDDGIGLDEFVDWLNESGCPIQRIADYGDWLQRFETALRALPDRQRHSSLLPLLHNYRQPERPVRGSIAPTDRFRAAVQEAKIGPDKDIPHVGAPIIVKYVSDLRLLGLL

SEQ ID NO: 25 - DNA, 3318 bp, Tsukamurella paurometabola
atgtcgattgagacggtgcagaacggcgtccccgcagagggctcggtgccccccgccgaccagcagaccgagcgactgccgcaggtgatcgccaggatcttcgcccagttcgcggatcgtccggccttcgcgacccgcgaggcggggccggggaccccctacgccaccgtctcctatcgggagatctggcggcgcgtcaccgcgctggtggcctcctggcagagcgaagtggctccgggagacttcgtcgccatcctcggcttcaccagctcggacttcgtgaccgtcgacctcgcgaccacactgctcggcgccccgaacgtgccgctccaggccggggcccccgccgctcgcatcgcgaccatcctcgatgagacccggccgaagatcctcgccgtgagtgccgatcaggtcgacctcgcccaggaggctctggccgagtccgcggctaccccgcgggtggtcgtcttcgacggcgaacgcgacggctacgagggcatcgaggcggacatcctttccggctccgccctgccggcaccggagttcttcgcgcccgagcccggcaccgatcctctcgtcacgctcatctacacatccggcagcaccggtaccccgaagggggccatgtacaccgagcagttggttcgcgatgcctggctcaaggtggacagcatcgtcgacatcgacatgccggccgagtcgctcctgcacttcctgcctatgagccatatgtacgggcgcaactggctgatcgccggcctggcatcgggcgggaccgggtacttcgccggcgcctccgatatgtccaccctgttcgacgacctcgccgccgcccggcccaccgccatcggcctggtgccccgcgtgtgcgagctgatacaccagcgctatctggccgtcgaggcggacactgatgcggagaccgcgcgcgtcgaactgcgtgaccgggtactcggcggtcggctgcaggccgcgatgtgcggtagcgccgccctctcgtcggagctgcagaccttcatggagtggttgctcggaatcgatatccagatcggctacggatccaccgaggccggtggtgtcatccgcgacggagtggtcgttcggccgccggtcacggagtacaagctgatcgatgtccccgaactgggctacttcgtcaccgactccccgcatccacgcggcgaactcctggtcaagtcgacgcagttgattcccgggtactacaactccgacaagcggatccgcgacgacgaaggcttctaccgcaccggcgatgtgatggccgagctgggacccgaccggctcgagtacgtcgaccggcggagcaacgtgatcaagttggcacagggagagttcgtgccgatcgcccaactcgaggccatctacgccgccggtcccgatgtgcaccagatcttcctgtacggaaccagcgaacgctcctacctgatcggcgtcgtcgtgcccgcgccgggacccgacggcgagaccgatgcgcagacccgcacccgcgtactcgatggcctggccgcgatcgcccgtgagaacgatctcgctgcctacgaggtgccgcgcgatgtgctcatcgaacgtgatcccttctctcaggagaacgggctgcggtcggggatcggcaagctggtgcgcccggccctcatcgcccgctacggtgaccggttgcacgacctctacgcccaggccgacacccgtcaacgcgagggcttgcgcgctctcgacgcctcgggcccgatcatcgacaccgtgctcggggcggctgcgttgacgctcggcgcggatatcgcggacttcgacgccgacactcgattcggcgacctcggtggcgactcgttgtcggcgctctcgctcgcgacgacgctcgaaggcctctacgacgtgcccgtccccgtgcagacgatcgtcggaccgaccgccacactcggcggcgtcgcccggcacatcgagaaggctcgatcgggtggcgtcgcggcaccgaccgccgactcggtgcacggcgtgggtgcgagcgtcgcccgggccaccgacctgacgctggagaagttcatcgaccccgagctcctcgcgctcgcgccgacgcttcccgcggcgaccggtgagccgaacaccgtgctgctcaccggatccaccggctacctcggccgcttcctgctgctggactggttgcgacgggtcgctccgcacggcggcaccgtgatcgcgctggtgcgcggcgccgacgccgacgatgcgcgacgccgcgtcacggccgcgatcggtgactcggatcctgacctgacacaagagttcacgtcactcgcggagcatcacctccacgtgatcgccggtgacttcggcagccccgcactcggactcgacgatgccacctggagcgatctcgccgggcgagtcgatcacgtggtgcactgcggcgcgctcgtcaaccacgtgctgccctacgaccaactgttcggtcccaatgtggtggccaccggcgaagtggtgcgactcgcactcaccacgcgccgcaagtccgtggattacgtctccacggtggctgtggttccgcaggatgacggccgcgtcctggtcgaggacgacgatgttcgcgagctcggcgccgaacggcgcatcggggccgatgcctacgcgaacggctacgccgtgagcaaatgggcgggcgaagtgctgttgcatgaggcagccgacctggcggacctgccggtgcgggtgttccgctccgatatgatcttggcgcacagtcgattccacggacagttcaacgaggtcgaccagttcacccgcctgctcctgagtatcgccgagaccggactggcgccggcgtcgttctacacgccggatccgagtggacaccgcccgcactacgacgggctgccggtggacttcaccgccgaagcgatcaccacgctcagcgccgcggggcgttcggggtaccggaccttccacgtgctcaacgccaacgatgacggcgtgagcctggacagcttcgtcgactggatcgccgcctcgggccggagcatcgaacggatcgacgactacgacacctggttcgcccggttcgagcaggcgctccagcagctccccgatgaggcgcgccagcggtcggtgctgcccctgctgcacgcggtgcgcgagccggctccggccgccgggacctccgcgctgtcggtggaccggttccgtggtgcggtgcgtgagaccggagtaggaccgggggacatcccggtgctcgatcgcgccctgatcgagaagtacctgcgcgacttcgagaccgcgggctggctcgcgcccggtgcgcgcgactga

SEQ ID NO: 26 - protein, 1105 aa, Tsukamurella paurometabola
MSIETVQNGVPAEGSVPPADQQTERLPQVIARIFAQFADRPAFATREAGPGTPYATVSYREIWRRVTALVASWQSEVAPGDFVAILGFTSSDFVTVDLATTLLGAPNVPLQAGAPAARIATILDETRPKILAVSADQVDLAQEALAESAATPRVVVFDGERDGYEGIEADILSGSALPAPEFFAPEPGTDPLVTLIYTSGSTGTPKGAMYTEQLVRDAWLKVDSIVDIDMPAESLLHFLPMSHMYGRNWLIAGLASGGTGYFAGASDMSTLFDDLAAARPTAIGLVPRVCELIHQRYLAVEADTDAETARVELRDRVLGGRLQAAMCGSAALSSELQTFMEWLLGIDIQIGYGSTEAGGVIRDGVVVRPPVTEYKLIDVPELGYFVTDSPHPRGELLVKSTQLIPGYYNSDKRIRDDEGFYRTGDVMAELGPDRLEYVDRRSNVIKLAQGEFVPIAQLEAIYAAGPDVHQIFLYGTSERSYLIGVVVPAPGPDGETDAQTRTRVLDGLAAIARENDLAAYEVPRDVLIERDPFSQENGLRSGIGKLVRPALIARYGDRLHDLYAQADTRQREGLRALDASGPIIDTVLGAAALTLGADIADFDADTRFGDLGGDSLSALSLATTLEGLYDVPVPVQTIVGPTATLGGVARHIEKARSGGVAAPTADSVHGVGASVARATDLTLEKFIDPELLALAPTLPAATGEPNTVLLTGSTGYLGRFLLLDWLRRVAPHGGTVIALVRGADADDARRRVTAAIGDSDPDLTQEFTSLAEHHLHVIAGDFGSPALGLDDATWSDLAGRVDHVVHCGALVNHVLPYDQLFGPNVVATGEVVRLALTTRRKSVDYVSTVAVVPQDDGRVLVEDDDVRELGAERRIGADAYANGYAVSKWAGEVLLHEAADLADLPVRVFRSDMILAHSRFHGQFNEVDQFTRLLLSIAETGLAPASFYTPDPSGHRPHYDGLPVDFTAEAITTLSAAGRSGYRTFHVLNANDDGVSLDSFVDWIAASGRSIERIDDYDTWFARFEQALQQLPDEARQRSVLPLLHAVREPAPAAGTSALSVDRFRGAVRETGVGPGDIPVLDRALIEKYLRDFETAGWLAPGARD

SEQ ID NO: 27 - DNA, 3435 bp, Cyanobium sp.
gtgaatgagtcttccgcggaccagagttccggcaacgtttccgaggggtggcctgatgcttcggtcacagcacgggccctgcaggctcacctgcgctacgaacagatcatcgatgccattctgagcggctacgccgagcgccctgctctggcggagcgttcctacctggtgcggccggacccgagcacaggtcaaacggtgcgtgtccacgagcaggccttccgctcgatcagctaccgaaccctgcaggaacgggttcatgccctcaccatggcctggcgccttcatcccgatagcccggtgcaagcgggagccttcgtggtgctggtgggatttgccagcatcgattacgccgttcttgatctggcactggcctacaccaagggcgtgccggtgcccctgtcaccgaaccattccagcgaggacgatgacgccatcctcggcacagtccagcccgtcactctggcggtatcgatcagtgagttctctggctgtgtcgacctgatcgcccgatcgacgtcgatccgaactgtgatcgtctttgaccttgaccctgccgtcgactgcgagcgcgccgcactggagagcggcatccgggcactcaacgagaaggggtcagacgttgtcgttcagacactgcaggatctgattgacgttgggagagacgcagagttcagcttcctgccgatccaggcgcaggatcaagatgacctggcacttctgattcacacatccggcagcacaggcacacccaagggagcctgcatctcatcccgtgcactgatcaacacctggcgccatgtttccggtccctatccaaaagtgaccgtggttctggcacccttccaccacatgatgggacgagactcgatgatcacggcattgggcgcgggcggcaccgcctacttcacgctcaggcctgacctttcgaccgtgattgaagacatcagactggcacggcccacaggcctggtgctgtttccccgcctctgcgaagtgatcgaacaccacctgactactgcgccggagtattcaggcaacgagatcctcggaggcagactgcaatccattgtggtggcctcggctccgatcacgccacgcttgaaggcatccctggagtgcctccttggggtgcctgtgagcgaaggctacagcagcacggaaacagccagtggcgggctggcgatgaatggactgctgaaccgcaacaacattctcgcgtatcgccttcgcgatgtgcccgaggcagggtattcagtgaatgatcggccctttccgcgcggagaactctgcgtgaagacccgcttcggtatctcaggctatttcagaaatccagaggccactgcagagctgttcgacgacgatggcttctattgcaccggtgacatcgttgaagagcgggcccccgatcaaatcgccatcatcgaccggcgaaagaatgtcatcaagctggcgcagggtgaatatgtcgctgtgggcaggctggaacagcttttccaggaaggttgtggttgcgtgcagcagattcacctccacggcgacagcacaagggcctatctgctggcagtcgtggtacctgatcgcaacacccttgcaccgcccgggtcacggcaggccagtgaggccgagttaaaggcacgggtgcgcgaggagattctcaccttggcaaaccaacgggagctgcgcggcttcgagatccctcgagacctgatcctggcggaggaacccttctcccagcagaacggtctgctgtcgtccttgggtaagccgatccgcccggccatccgcgcgcgctaccgcagccggctggagagcctgtatgccagccatgaggccacccgaggcactgagctcgaggccatcagagcgtcagctggcgcggtggatgtggaaaccaccctgttggcgctgctgagcagcacgctgggtgtggtgtgtggggctgccgatcggcagacgagtttccgcgagctggggggcgactccctggccgctgtgcagctggcgatggagatcaagaagcagttcggggtggggctggaagggagccagattctcgggccgggcggcacggtggaagcgtgggcgcggaggatccacaccgcctccatccagcaggccccgcaccagcgggttggcagtcccctcgccgccattccggccgaggggtggctgaagccggaccactacaggctggagaacctgatcgggattcccatcggtacaccctcagccgaggtggccaggcccacaggcgggccccctacggttctgctcaccggtgccaccggttttctgggggggcgcttgtgcctggagtggctgcaacggctggctggccaggggggcaggctgatctgtctggtgcgcccctcgaacagccattccgcctgggagcgactgaggaaccgcttctcccatctggaacccgagcaggtggcacgcttccgcgagctggcgggaaggcatctggaggtgattccggcggacatcggagagcccggcctggggcttgaaccgggttgccaggagcggctcgccactgaggtggacgcgatctgtcactgcgcagcggaagtgaatcaccggctgccctatcgccacctctaccggcccaatgtgatcggcaccgcggagatcattcacctggcgatcacgacgcggctgaaatcggtggacttcatctccagcatcggggtggcttccctgccccggcggccgggagggagcatcccggtggagggcggctacgcccggggctacttcgccagcaagtgggcttgcgagcaactgctgcgctccacccatgactgcaccggtgtgcccgtacgggtgattcggcccagcctcattcttcccgatcgtgtgctggccggggagatgaacccggacgatctgctttcaagactgctgtacagcatcctggtgaccgggatcgcccccgggtgctttggggaggagtcgcagaacagtggacgatcggggttctcggtgcagggcctccccgtcgaccagttggcgcagaccatccttgccctcggggaagcgcgcacggagggatttcatgtgctcaacctcaacgctgacagtggcagcggtgttcccctggatgccatcctccaggacatcgccgccaaaggaatcaggctgcgacgggtggagggctatgacctctggctcgacgcgatcacaacccgcctgcgtcgcctgccagccgagcaacgggcccgttccctgctggatgtggcggaagcctatgcaggatcagcaggccagacaacgcagagcagcggtgaaatgcaggcgggcagcagctcctgcccggaggagatcaccagcctgcaaccggacttcagtagggcctacaggcgcaagatcgtggatgatctggctcggtgggggctgatcgagcctccaggacccgtggatcagtga

SEQ ID NO: 28 - protein, 1144 aa, Cyanobium sp.
MNESSADQSSGNVSEGWPDASVTARALQAHLRYEQIIDAILSGYAERPALAERSYLVRPDPSTGQTVRVHEQAFRSISYRTLQERVHALTMAWRLHPDSPVQAGAFVVLVGFASIDYAVLDLALAYTKGVPVPLSPNHSSEDDDAILGTVQPVTLAVSISEFSGCVDLIARSTSIRTVIVFDLDPAVDCERAALESGIRALNEKGSDVVVQTLQDLIDVGRDAEFSFLPIQAQDQDDLALLIHTSGSTGTPKGACISSRALINTWRHVSGPYPKVTVVLAPFHHMMGRDSMITALGAGGTAYFTLRPDLSTVIEDIRLARPTGLVLFPRLCEVIEHHLTTAPEYSGNEILGGRLQSIVVASAPITPRLKASLECLLGVPVSEGYSSTETASGGLAMNGLLNRNNILAYRLRDVPEAGYSVNDRPFPRGELCVKTRFGISGYFRNPEATAELFDDDGFYCTGDIVEERAPDQIAIIDRRKNVIKLAQGEYVAVGRLEQLFQEGCGCVQQIHLHGDSTRAYLLAVVVPDRNTLAPPGSRQASEAELKARVREEILTLANQRELRGFEIPRDLILAEEPFSQQNGLLSSLGKPIRPAIRARYRSRLESLYASHEATRGTELEAIRASAGAVDVETTLLALLSSTLGVVCGAADRQTSFRELGGDSLAAVQLAMEIKKQFGVGLEGSQILGPGGTVEAWARRIHTASIQQAPHQRVGSPLAAIPAEGWLKPDHYRLENLIGIPIGTPSAEVARPTGGPPTVLLTGATGFLGGRLCLEWLQRLAGQGGRLICLVRPSNSHSAWERLRNRFSHLEPEQVARFRELAGRHLEVIPADIGEPGLGLEPGCQERLATEVDAICHCAAEVNHRLPYRHLYRPNVIGTAEIIHLAITTRLKSVDFISSIGVASLPRRPGGSIPVEGGYARGYFASKWACEQLLRSTHDCTGVPVRVIRPSLILPDRVLAGEMNPDDLLSRLLYSILVTGIAPGCFGEESQNSGRSGFSVQGLPVDQLAQTILALGEARTEGFHVLNLNADSGSGVPLDAILQDIAAKGIRLRRVEGYDLWLDAITTRLRRLPAEQRARSLLDVAEAYAGSAGQTTQSSGEMQAGSSSCPEEITSLQPDFSRAYRRKIVDDLARWGLIEPPGPVDQ

SEQ ID NO: 29 - DNA, 3522 bp, Mycobacterium avium
atgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccattacgtacggcgaagtggcgcagcgtgtttcggcgctgggccgcgccctgtctgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccggcaccggcgtggccgtccagacgctggccgagctgctggagcgcggcaaggacctgcccgccgtcgcggagccgcccgccgacgaggactcgctggccctgctgatctacacctccgggtccaccggcgcccccaagggcgcgatgtacccgcagagcaacgtcggcaagatgtggcgccgcggcagcaagaactggttcggcgagagcgccgcgtcgatcaccctgaatttcatgccgatgagccacgtgatgggccgaagcatcctctacggcacgctgggcaacggcggcaccgcctacttcgccgcccgcagcgacctgtccaccctgctcgaggacctcgagctggtgcggcccaccgagctcaacttcgtcccgcggatctgggagacgctgtacggcgaattccagcgtcaggtcgagcggcggctctccgaggccggggacgccggcgaacgtcgcgccgtcgaggccgaggtgctggccgagcagcgccagtacctgctgggcgggcggttcaccttcgcgatgacgggctcggcgcccatctcgcccgagctgcgcaactgggtcgagtcgctgctcgaaatgcacctgatggacggctacggctccacggaggccggaatggtgttgttcgacggggagattcagcgcccgccggtggtcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccgacgagctggccgagctgcgccgcaacggtgcccaggcgccggtgttgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtgggcgtgatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgacacgctggcctccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaagctgctcgcgcactaccagcagctggctgccgatcacctggaggtcatcgccggcgacaagggcgaggccaatctgggcctgcgccaagatgtttggcaacggctggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctacggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcatcggtctggacgagtacgtcgattggctggtggacgccggctattcgatcgagcggatcgccgactactccgaatggctgcggcggttcgagacctcgctgcgggccctgccggaccggcagcgccagtactcgctgctgccgctgctgcacaactaccgcacgcccgagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctga

SEQ ID NO: 30 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYGEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSGTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVVDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQADELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDADTLASAPNLPKPATEVRTVLLTGATGFLGRYLALEWLERMDMVDGKVIALVRARSDEEARARLDKTFDSGDPKLLAHYQQLAADHLEVIAGDKGEANLGLRQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGIGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 31 - DNA, 3507 bp, Mycobacterium smegmatis
atgacgatcgaaacgcgcgaagaccgcttcaaccggcgcattgaccacttgttcgaaaccgacccgcagttcgccgccgcccgtcccgacgaggcgatcagcgcggctgccgccgatccggagttgcgccttcctgccgcggtcaaacagattctggccggctatgcggaccgccctgcgctgggcaagcgcgccgtcgagttcgtcaccgacgaagaaggccgcaccaccgcgaagctcctgccccgcttcgacaccatcacctaccgtcagctcgcaggccggatccaggccgtgaccaatgcctggcacaaccatccggtgaatgccggtgaccgcgtggccatcctgggtttcaccagtgtcgactacacgacgatcgacatcgccctgctcgaactcggcgccgtgtccgtaccgctgcagaccagtgcgccggtggcccaactgcagccgatcgtcgccgagaccgagcccaaggtgatcgcgtcgagcgtcgacttcctcgccgacgcagtcgctctcgtcgagtccgggcccgcgccgtcgcgactggtggtgttcgactacagccacgaggtcgacgatcagcgtgaggcgttcgaggcggccaagggcaagctcgcaggcaccggcgtcgtcgtcgagacgatcaccgacgcactggaccgcgggcggtcactcgccgacgcaccgctctacgtgcccgacgaggccgacccgctgacccttctcatctacacctccggcagcaccggcactcccaagggcgcgatgtaccccgagtccaagaccgccacgatgtggcaggccgggtccaaggcccggtgggacgagaccctcggcgtgatgccgtcgatcaccctgaacttcatgcccatgagtcacgtcatggggcgcggcatcctgtgcagcacactcgccagcggcggaaccgcgtacttcgccgcacgcagcgacctgtccaccttcctggaggacctcgccctcgtgcggcccacgcagctcaacttcgttcctcgcatctgggacatgctgttccaggagtaccagagccgcctcgacaaccgccgcgccgagggatccgaggaccgagccgaagccgcagtcctcgaagaggtccgcacccaactgctcggcgggcgattcgtttcggccctgaccggatcggctcccatctcggcggagatgaagagctgggtcgaggacctgctcgacatgcatctgctggagggctacggctccaccgaggccggcgcggtgttcatcgacgggcagatccagcgcccgccggtcatcgactacaagctggtcgacgtgcccgatctcggctacttcgccacggaccggccctacccgcgcggcgaacttctggtcaagtccgagcagatgttccccggctactacaagcgtccggagatcaccgccgagatgttcgacgaggacgggtactaccgcaccggcgacatcgtcgccgagctcgggcccgaccatctcgaatacctcgaccgccgcaacaacgtgctgaaactgtcgcagggcgaattcgtcacggtctccaagctggaggcggtgttcggcgacagccccctggtacgccagatctacgtctacggcaacagcgcgcggtcctatctgctggcggtcgtggtcccgaccgaagaggcactgtcacgttgggacggtgacgaactcaagtcgcgcatcagcgactcactgcaggacgcggcacgagccgccggattgcagtcgtatgagatcccgcgtgacttcctcgtcgagacaacacctttcacgctggagaacggcctgctgaccggtatccgcaagctggcccggccgaaactgaaggcgcactacggcgaacgcctcgaacagctctacaccgacctggccgaggggcaggccaacgagttgcgcgagttgcgccgcaacggagccgaccggcccgtggtcgagaccgtcagccgcgccgcggtcgcactgctcggtgcctccgtcacggatctgcggtccgatgcgcacttcaccgatctgggtggagattcgttgtcggccttgagcttctcgaacctgttgcacgagatcttcgatgtcgacgtgccggtcggcgtcatcgtcagcccggccaccgacctggcaggcgtcgcggcctacatcgagggcgaactgcgcggctccaagcgccccacatacgcgtcggtgcacgggcgcgacgccaccgaggtgcgcgcgcgtgatctcgccctgggcaagttcatcgacgccaagaccctgtccgccgcgccgggtctgccgcgttcgggcaccgagatccgcaccgtgctgctgaccggcgccaccgggttcctgggccgctatctggcgctggaatggctggagcgcatggacctggtggacggcaaggtgatctgcctggtgcgcgcccgcagcgacgacgaggcccgggcgcgtctggacgccacgttcgacaccggggacgcgacactgctcgagcactaccgcgcgctggcagccgatcacctcgaggtgatcgccggtgacaagggcgaggccgatctgggtctcgaccacgacacgtggcagcgactggccgacaccgtcgatctgatcgtcgatccggccgccctggtcaatcacgtcctgccgtacagccagatgttcggacccaatgcgctcggcaccgccgaactcatccggatcgcgctgaccaccacgatcaagccgtacgtgtacgtctcgacgatcggtgtgggacagggcatctcccccgaggcgttcgtcgaggacgccgacatccgcgagatcagcgcgacgcgccgggtcgacgactcgtacgccaacggctacggcaacagcaagtgggccggcgaggtcctgctgcgggaggcgcacgactggtgtggtctgccggtctcggtgttccgctgcgacatgatcctggccgacacgacctactcgggtcagctgaacctgccggacatgttcacccgcctgatgctgagcctcgtggcgaccggcatcgcgcccggttcgttctacgaactcgatgcggacggcaaccggcagcgcgcccactacgacgggctgcccgtggagttcatcgccgaggcgatctccaccatcggctcgcaggtcaccgacggattcgagacgttccacgtgatgaacccgtacgacgacggcatcggcctcgacgagtacgtggactggctgatcgaggccggctaccccgtgcaccgcgtcgacgactacgccacctggctgagccggttcgaaaccgcactgcgggccctgccggaacggcaacgtcaggcctcgctgctgccgctgctgcacaactatcagcagccctcaccgcccgtgtgcggtgccatggcacccaccgaccggttccgtgccgcggtgcaggacgcgaagatcggccccgacaaggacattccgcacgtcacggccgacgtgatcgtcaagtacatcagcaacctgcagatgctcggattgctgtaa

SEQ ID NO: 32 - protein, 1168 aa, Mycobacterium smegmatis; identical to SEQ ID NO: 20

SEQ ID NO: 33 - DNA, 3525 bp, Mycobacterium intracellulare
atgtcgactgccattcatgacgaacacctcgaccgtcgcatcgaggaactcatcgccaacgacccccaattcgccgccgcccgaccggacccggccatcaccgccgccaccgaagcgcccgggctgcggctgccgcagatcatccggaccgtgctcgacggctacgccgaccggcctgccctggcgcagcgcgtcgtggagttcgtcaccgacgccaagaccgggcggacgacggccgagctgctcccccgtttcgagaccatcacgtatggcgaactcggcgaacgggtttcggccctcggccgtgcctgggccggcgacgcggtgcgccccggcgaccgcgtctgcgtgctcggcttcaacagcgttgactacgccaccatcgacatcgcgctgggcaccatcggggccgtgtcggtgccgctgcagaccagcgcggcgatctcctcgttgcagccgatcgtcgccgagaccgagcccagcctgatcgcctcgagcgtcaaccagctgcccgacgcggtggagctgatcctggccggcgaccacgtgcccggcaagctcgtcgtgttcgactaccagccccaggtcgacgaccagcgcgaggccgtggaggccgccgccgcgcggttggccgactccggcgtcgcggtcgaggctctcgccgacgtgctgcggcgcggcaaggacctgccggccgtcgagccgccggcgagcgacgaggactcgctggccctgctgatctacacctccggcagcaccggcgcgcccaagggcgcgatgtacccgcagagcaacgtcggcaagatgtggcggcgcgggagcaagaactggttcggggaaagcgccgcgtcgatcaccctcaacttcatgccgatgagccacgtcatggggcgcggaatcctctacggcacgctgggcaacggcggcaccgcgtacttcgccgcccgcagcgacctgtccaccctgctcgaggacctcgagttggtgcggcccaccgagatgaacttcgtcccccgcatctgggagacgctgtacggcgaattccagcgccaggtcgagcggcggctggccgacggcgatgcgggcccggaggcccgcgagactgtggcggctgcggtgttggaagaacagcgccagtacctgctgggcgggcggttcatcttcgcgatgacgggctcggcacccacctcgccggagctcaaggcgtgggccgagtcgctcctgcagatgcacctgatggacggctacggctccaccgaggccggaatggtgttgttcgacggggagattcagcgtccgccggttattgattacaagctggtcgacgttccggatctgggctatttcagcaccgaccgtccgcatccgcgcggtgagttgttgctgcggaccgagaacatgttcccgggttattacaagcgggccgagaccaccgcgaacgtgttcgacgaggacggttattaccgcaccggtgacgtgttcgccgagatcgcgccggaccggctggtgtatgtcgatcgccgcaacaacgtgctcaagttggcccagggcgagttcgtgacgctggccaagctggaggcggtgttcggcaacagcccgctgatccgccagatctacgtttacggcaacagctcccagccctacctgctggccgtggtggtgccgaccgaggaagcgttggcggacaacgatcttgagtcgctcaagccgaagatcgccgactcgctgcagaaggtcgccaaggagaccggcctgcagtcctacgaggtgccgcgcgacttcatcatcgagaccacgccgttcaccctggaaaacggcctgctgaccgggatccgcaagctggcgtggcccaagctcaaggcgcactacggggatcggctcgagcagatgtatgccgagctggccgcgggacaggccaacgagttggccgaactgcgccgcagcggcgcggcggcgccggtggcccagaccgtgagccgggccgcggccgccctgctgggtgcgacggccggggatctgtccgcagatgcccacttcaccgatcttggtggagactcgttgtcggcgttgaccttcggcaacctgctgcgcgagatcttcgatgtcgacgtgccggtgggggtgatcgtcagcccggccaacgacctggcggggatcgccgcctacatcgaggccgagcggcagggctccaagcgcccgacgttcgccgccgtgcacggtcgcggtgcgaccatggtgcacgccagtgacctcacgctggacaagttcctcgacgaggcgaccctggccgccgcgcccagcctgcccaagccggccaccgaggtgcgcaccgtgctgttgaccggcgcgaccggctttttgggccgctacctggcgctggactggctcgagcggatggacatggtcgacggcaaggtcatcgccctggtgcgggcccgcaccgatgaggaggcgcgcgcccggctggacaagaccttcgacagcggcgaccccaaactgctggcgcactaccagcggctggccgccgaccacctcgaggtcatcgccggcgacaagggtgaggccaacctcggcctggacccccagacctggcagcgactggccgaggaggtcgacgtcatcgtcgaccccgccgcgctggtcaaccacgtgctgccctacagcgagctgttcggccccaacgccctgggcaccgcggagctgatccggatcgcgctgacctccaggcaaaagccctacacctacgtgtcgacgatcggggtgggcgatcagatccagccaggtgagttcgtcgagaacgccgacatccgccagatcagcgccacccgcgagatcaacgacggctacgccaacggctacggcaacagcaagtgggccggcgaggtgttgctgcgcgaggcccacgacctgtgcggcctgcccgtcacggtgttccgctgcgacatgatcctggccgacaccacctatgccgggcagctcaacctgcccgacatgttcacccggctgatgctgagcctggtcgccaccggtatcgcgcccgggtcgttctacgaactggacgccgacggcaaccgccagcgggcacactacgacggtttgccggtcgagttcatcgccgcggcgatctcgacgctggggacccaaatcaccgacagcgacacgggctttcagacctaccacgtgatgaacccctacgacgacggcatcgggctggatgagtacatcgattggctgatcgaggccgggtattcgatcgagcggatcgccgattactccgagtggctgcggcgcttcgagacctcgctgcgggccctgcccgatcggcagcgtcagtactcgctgctgccgctgctgcacaactaccagaagccggaaaagccgatcaacggctcgatggcgcccaccgacgtgttccgtgccgcggtgcaggaagcgaaaatcggccccgacaaagacatcccgcacgtctcggcgccggtgatcgtcaagtacatcaccgacctggagttgctcggactcctctga

SEQ ID NO: 34 - protein, 1174 aa, Mycobacterium intracellulare
MSTAIHDEHLDRRIEELIANDPQFAAARPDPAITAATEAPGLRLPQIIRTVLDGYADRPALAQRVVEFVTDAKTGRTTAELLPRFETITYGELGERVSALGRAWAGDAVRPGDRVCVLGFNSVDYATIDIALGTIGAVSVPLQTSAAISSLQPIVAETEPSLIASSVNQLPDAVELILAGDHVPGKLVVFDYQPQVDDQREAVEAAAARLADSGVAVEALADVLRRGKDLPAVEPPASDEDSLALLIYTSGSTGAPKGAMYPQSNVGKMWRRGSKNWFGESAASITLNFMPMSHVMGRGILYGTLGNGGTAYFAARSDLSTLLEDLELVRPTEMNFVPRIWETLYGEFQRQVERRLADGDAGPEARETVAAAVLEEQRQYLLGGRFIFAMTGSAPTSPELKAWAESLLQMHLMDGYGSTEAGMVLFDGEIQRPPVIDYKLVDVPDLGYFSTDRPHPRGELLLRTENMFPGYYKRAETTANVFDEDGYYRTGDVFAEIAPDRLVYVDRRNNVLKLAQGEFVTLAKLEAVFGNSPLIRQIYVYGNSSQPYLLAVVVPTEEALADNDLESLKPKIADSLQKVAKETGLQSYEVPRDFIIETTPFTLENGLLTGIRKLAWPKLKAHYGDRLEQMYAELAAGQANELAELRRSGAAAPVAQTVSRAAAALLGATAGDLSADAHFTDLGGDSLSALTFGNLLREIFDVDVPVGVIVSPANDLAGIAAYIEAERQGSKRPTFAAVHGRGATMVHASDLTLDKFLDEATLAAAPSLPKPATEVRTVLLTGATGFLGRYLALDWLERMDMVDGKVIALVRARTDEEARARLDKTFDSGDPKLLAHYQRLAADHLEVIAGDKGEANLGLDPQTWQRLAEEVDVIVDPAALVNHVLPYSELFGPNALGTAELIRIALTSRQKPYTYVSTIGVGDQIQPGEFVENADIRQISATREINDGYANGYGNSKWAGEVLLREAHDLCGLPVTVFRCDMILADTTYAGQLNLPDMFTRLMLSLVATGIAPGSFYELDADGNRQRAHYDGLPVEFIAAAISTLGTQITDSDTGFQTYHVMNPYDDGIGLDEYIDWLIEAGYSIERIADYSEWLRRFETSLRALPDRQRQYSLLPLLHNYQKPEKPINGSMAPTDVFRAAVQEAKIGPDKDIPHVSAPVIVKYITDLELLGLL

SEQ ID NO: 35 - DNA, 3522 bp, Mycobacterium smegmatis; identical to SEQ ID NO: 21

SEQ ID NO: 36 - protein, 1173 aa, Mycobacterium smegmatis; identical to SEQ ID NO: 22

SEQ ID NO: 37 - DNA, 3525 bp, Mycobacterium kansasii
atgtcgactaccactcgtgacgagcgcctcgagcgccgcatcgacaccctgatccacgacgacgcacagttcgccgccgccaagccggacccggcaatcgccgccgccctggaaaagcccggcctgagcctgccagagatcatccagaccgcgctgcagggctacgccgaccggccggctctcgggcagcgcgccgtcgagttcgtcacggacacccagaccggccgcacctcggtgcggctgctgacccgcttcgagaccatcacctaccgtcagctcggcgaccgggtcggtgcgctggcgcgcgccctgacccacgactcggtgcacgccggcgaccgggtctgcgtgctgggcttcaacagcctcgactacaccaccatcgacatggcgctggcgaaggtcggcgcggtgtcggtgccgctgcagaccagtgcggcggttacccagctgcagccgatcgtggccgagaccgagcccaccatgatggcggccagtgtgaatcagctgtcggatgccgtggacgtgctgttgagcggccacctgccggccaagctggtggtgttcgactaccaccccgaggtggacgaccagcgcgaggcgctcgacacggcccgggagcggttggcggacacagcggtggttgtccagaccctcaaggacgtcctggaccacggcgcaacgctggcggcggggtcggttgccgagccgctcgcggcgtcgggcgacaacgactcgctggcgctgctgatctacacctccggcagcaccggcgcacccaaaggtgcgatgtatcgacagagcaacgtcggcaagatgtggcgccggtcgagcaagaactggttcgggcccaccgcggcgtcgatcaccctcaacttcatgccgatgagccacatcatgggacgtggagtcctctacggcacgctcggcaacggcggcaccgcgtacttcgcggccaggagcgacctctcgacgctgctggaagacttgcggctggtgcggcccaccgagttgaacttcgtgccgcggatctgggagaccttgtacggcgaataccagcgcgcggtcgaccagcggtcggtcgatcccggtgaacccgccgcccgcgaagccgtcgaagcccaggtcatggccgagcagcgccaggacctgctgggtgggcgctatatcttcgcgatgacgggctcggcgcccatgtccccggagctgcggaactgggtggaagcgctgctggagatcccactgctcgacggttacggctccaccgaggccgggatggtcatgttcgacggtgaaattcagcgcccgccggtgatcgactacaagctggtcgacgtgcccgatctgggctacttcagcaccgaccagccgtatccgcggggcgagttgctgctcaagaccgagaacatgttcccaggctattacaagcggccggaggttacggccagcgtgttcgacgcggacggctactaccggaccggagacgtcgtggccgaggtcgctccggaccggctggtgtacgtggaccgccgcaacaacgtgctgaagcttgcccagggcgagttcgtgaccgtcgccaagctggaggcggtgttcggcaacagcccgctggtgcgccagatctacgtctacggcaacagcgcgcatccctacctgttggccgtggtggtgccaacggaagaagcgtcggcgggcactgacatagcggccttgaagccgctgatcgccgactcgctgcagaccgtcgccaaagaggccggcctgcagtcctacgaggtgccgcgcgacttcctcatcgagacaacaccattcacgctggagaacggtctgctcaccggtatccgcaagctggcgtggccgaagctgaggcagcattacggcgaacggctggagcagctctacacggagctggccgcgagccaggccaacgagttgagcgagctgcggcgcagcggggcccatgcgccggtgctggaaacggtgagccgggcggcgggcgcgctgctgggggcggcgagcaccgccttgtcacccgacgcgcacttcaccgatctgggtggagactcgttgtcggcgttgacattcggcaacctgctgcgggagatcttcgacgttgacgtaccggtgggtgtgatcgtcagcccggccagcgacctggcggcgatcgccgcttacatcgagggcgagcggcagggcagcaagcgacccacgttcgccgtgattcacggtcgggacgcgctagaggtgcatgcgagtgacctcaccctggacaagttcatcgacgcatccaccctggcagccgcaccggtactgccgcctccgagcgccgcggtgcgcaccgtcctgttgaccggcgcgaccggctttttgggccgctacctggcgctggactggctggagcgcatggacctggtcgacggcaaggtgatcgccctggtgcgggcgaagtcggacgacgatgcccgggcacgcctggacaagacgttcgacagcggagaccccgagctgctgacccactaccggcggctggcgaccgaccacttggaggtcatcgccggcgacaagggcgaggccaacctcgggctggatcagctgacctggcagcggctggccgacaccgtcgacctgatcgtcgacccggccgcgttggtcaaccacgtgctgccctacagcgagctgttcggccccaacgcgctgggcaccgccgaattgatccggatagcgctgaccggcaagctcaagccctacacctacgtctcgaccatcggggtgggcgaccagatcgagccgggcaagttcaccgaggacgccgacatccggcacatcagcgcgacccggaagatcaacgacagttacgccaacggctacggcaacagcaagtgggccggcgaggtgctactgcgcgaggcccacgacctgtgcgggctgccggtcgcggtgttccgctgcgacatgatcctggccgacaccacgtgggcgggtcagctcaacgtgccggacatgttcacccggatgatgctgagcctggtggccaccggcattgcacccggttcgttctacgagctggacgccgacggcaaccggcagcgtgcccactacgacggcttgccggtcgagttcatcgccgaggcgatcgcgacgctgggcgcccgggacgggaagggtttccagacctaccacgtgatgaacccctacgacgacggcatcgggatggaccggttcgtcgactggctcgtcgacgccggatgcgccatccaccgcatcgacgactacggcgactggctgcgacgattcgagaccgcgctgcgcggcctgcccgaaaagcagcgtcacgcgtcactactgccgttgctgcacaactaccagaagccggcgccgccgctgcgcgggtcgatggctccgaccgaccggttccgggcggccgtgcaggacgcgaaagtgggcccggacaaggacatcccgcacatctcgccgcagatcatcgcgaagtacctcagtgatctgcgcttgctcgggctcctctga

SEQ ID NO: 38 - protein, 1174 aa, Mycobacterium kansasii
MSTTTRDERLERRIDTLIHDDAQFAAAKPDPAIAAALEKPGLSLPEIIQTALQGYADRPALGQRAVEFVTDTQTGRTSVRLLTRFETITYRQLGDRVGALARALTHDSVHAGDRVCVLGFNSLDYTTIDMALAKVGAVSVPLQTSAAVTQLQPIVAETEPTMMAASVNQLSDAVDVLLSGHLPAKLVVFDYHPEVDDQREALDTARERLADTAVVVQTLKDVLDHGATLAAGSVAEPLAASGDNDSLALLIYTSGSTGAPKGAMYRQSNVGKMWRRSSKNWFGPTAASITLNFMPMSHIMGRGVLYGTLGNGGTAYFAARSDLSTLLEDLRLVRPTELNFVPRIWETLYGEYQRAVDQRSVDPGEPAAREAVEAQVMAEQRQDLLGGRYIFAMTGSAPMSPELRNWVEALLEIPLLDGYGSTEAGMVMFDGEIQRPPVIDYKLVDVPDLGYFSTDQPYPRGELLLKTENMFPGYYKRPEVTASVFDADGYYRTGDVVAEVAPDRLVYVDRRNNVLKLAQGEFVTVAKLEAVFGNSPLVRQIYVYGNSAHPYLLAVVVPTEEASAGTDIAALKPLIADSLQTVAKEAGLQSYEVPRDFLIETTPFTLENGLLTGIRKLAWPKLRQHYGERLEQLYTELAASQANELSELRRSGAHAPVLETVSRAAGALLGAASTALSPDAHFTDLGGDSLSALTFGNLLREIFDVDVPVGVIVSPASDLAAIAAYIEGERQGSKRPTFAVIHGRDALEVHASDLTLDKFIDASTLAAAPVLPPPSAAVRTVLLTGATGFLGRYLALDWLERMDLVDGKVIALVRAKSDDDARARLDKTFDSGDPELLTHYRRLATDHLEVIAGDKGEANLGLDQLTWQRLADTVDLIVDPAALVNHVLPYSELFGPNALGTAELIRIALTGKLKPYTYVSTIGVGDQIEPGKFTEDADIRHISATRKINDSYANGYGNSKWAGEVLLREAHDLCGLPVAVFRCDMILADTTWAGQLNVPDMFTRMMLSLVATGIAPGSFYELDADGNRQRAHYDGLPVEFIAEAIATLGARDGKGFQTYHVMNPYDDGIGMDRFVDWLVDAGCAIHRIDDYGDWLRRFETALRGLPEKQRHASLLPLLHNYQKPAPPLRGSMAPTDRFRAAVQDAKVGPDKDIPHISPQIIAKYLSDLRLLGLL

SEQ ID NO: 39 - DNA, 3507 bp, Mycobacterium bovis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctactacgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 40 - protein, 1168 aa, Mycobacterium bovis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYYVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 41 - DNA, 3489 bp, Mycobacterium intracellulare
ttggccgcgaccgacgaacagttccgcaacgcccaacccgatctgtcgctgcagcaggcggcgcgccaaccgggcctgcgcctgccccagattctggagctgttcgtcgagggctacgccgatcggcccgcggtgggctggcgggccaggacactgagcaccgaccccgcgaccgggcgtaccaccacgcgactgctcccccgcttcgacaccatgacctaccgcgagctgtgggccgatgtgcgcgcgatcgccgccgcgtggcggcacgacgccgcgaaccccgtgtcgcccggggacttcgtcgcgacggtcggtttcgccagcgccgaatatctgaccctcgacctggtctgcggctacctcgggctggttgccgttccgctgcaacacaatacgaccccctcacggctgcgaccgatcgtcgacgaggtcgagccgtcgatactggccgccggcgtcggttatctcgacctcgcggtcgaggcggcgtcgggcagctcgtcgttgcggcggctcgtggtcttcgattaccagcccgaggtcgacgagcaacgcgaggcgctgcagcgcgcccaggcgacgctggcggccgccggcgcggcggtgaccatcgagaccctcgacgaaatcatcgaacgcggacgcgccctgccgcccgagcccatgtacaccggtgataccgatcagcggctggcgatgatcatgtacacctcgggcagcaccgggttacccaagggcgccatgtacaccgagcagatgctggccaaggtgtggaccaacgagctgatgcccgacttcgcggacacacccgtgttcaacgtcaacttcatgccgctgaatcacctcggtggccggataccgctgtcgaccgcgttccaggccggcggcaccagctatttcgtgccggaaagcgacctgtccacgttgttcgacgactggaacctggtgcgccccaccgagatgggcctggtaccccgggtggcggaaatgctctaccagcgctaccagagcgccgtcgaccgactcgtggcttcgggcgccgacgccggctccgccgaggcccgggcgcgggccgagctgcgtgagcatgtcctcggcgggcgcatcgtgaccgccttctgcgggacggcgccgctggccgcggagatgcgggccttcgtcgaaacctgtttggacgtccacgttctcgacggctacgggctgaccgaggtcggcatggtgaccaaggacgggcgcatgacccgtcccccggtgctcgactacaagctcatcgacgttcccgaactcggctatttccacaccgacaagccttatccgcgtggcgaattgctggtgaagtcgctgaccgcgacgccgggctacttcaaacgaccggacgtcaccgccaacgcgttcgatcccgacggctactaccggaccggcgatgtgatggccgagctcgagccggaccggctggcctacgtcgaccgccgcaacaacgtgttgaagttggcgcagggcgagttcgtcgccgtcgcccgcctggaggccgtcttcgccagcgcgccgctgatccgccagatcttcgtatacggcaacagcgaacgcccctatctgctggccgtcgtcgtgccgacggccgacgccgcggagcgattcaccggagatcccgagggcctcaaggccgccgtcgccgaatccctgcgccagtcggcgcaactcgccgaactgcagtcctacgaggtgcccgtcgacttcgtcgtcgagaccgagccgttcagcgaggacaacggcctgctctcgggcgtgggcaagctgctgcggccgaagctcaaggagcgctacgccgaccggctcgaacagctctacgccgagctggccgaaaaccgcgtgaccgagttgcgtgcgctgcgcgagggggcggacaaacaccccgtcgtcttcaccctcacccgggccgccgaggcgctactgggtgtggccggcggcccgcccgcccccgacgcactgttcatcgaactcggcggcgattccctgtcggcgctgaccttctccaacctgctgcgcgacatcttcgacgtcgacgtgccggtgggaatgatcaccgggcccgcgaccgacctgggccagctcgcggaatacgttgaatccgaacgcaaatcgggatcacgccggcccacattcgcgacggtgcacggacgcggcgccgccgaggtccgcgccgcggagctcaccctcgacaagttcatcgacgcgacgaccttggccgccgcaccgaacctgccgcgcgcgaccggcacaccccacacggtcctgctgaccggcgccaacggctacctcggccgcttcctggccctcgaatggctcgagcgcctcgccgagaccggcgggaagctcgtctccatcgtccgcgcgacggacaccgcggcggccgtcaaacggctggaggccgttttcgacagcggggatccgcagttgctggagcggttccggacgctggccgccgagcacctggaagtcatcgtcggcgacatcggtgagcccaatctcggcctggaccaagcgacttggcagcgcctggcccagagcgtggatctgatcgtccacccggccgcgttggtcaaccacgtgctgccgtacgaccaactgttcggtccgaacgtcgtcggcaccgccgagttgatccgcctggcgatcacgacgcgcatcaagcccgtcacctatctgtcgaccgtcgccgtggcgatgacggtcgatcccggcgagttcgccgaagacggcgacatccgcgcggtcagcgcggtacgcccgatcgacgacagctacgcgaacgggtacgcgaacagcaagtgggccggtgaggtgttgctgcgtgaggcgcacgacctgtgcgggttgccggtcgccgtcttccgctccgacatgatcctcgcgcacagccggtatgccgggcagctgaacgtgccagatgccttcacccgcttgatgttcagcctgctgaccaccggcatcgcgccgaccacgttctaccggaccgacgaacacggaaaccgagccgtggcccactacgacgggctgcccgccgacttcgtggccgaagcggtcaccacgctcggcgaacagatggcggccgaggaatccggcgggtaccgctcctatgacgtgatgaacccacacgacgacggcgtctccctggacgtgttcgtcgactggctgatcgccgccggacacgacatccggcgcatcgaggactatgacgaatggctgggccgcttcaccacggcgcttcgcgcgttaccggacaagcagcgccagcattcggtgttgccgctgctggacgcctaccgggaacccgcgacgccactgcggggagcgccggcccccaccgacgtcttccgccacgcggtgcggacggccaaaatcggtgcggacgaggacattccgcacctgtcggcggcgttgatcgacaagtacgtcgccgacctacgcctgctgggcttggtgtag

SEQ ID NO: 42 - protein, 1162 aa, Mycobacterium intracellulare
MAATDEQFRNAQPDLSLQQAARQPGLRLPQILELFVEGYADRPAVGWRARTLSTDPATGRTTTRLLPRFDTMTYRELWADVRAIAAAWRHDAANPVSPGDFVATVGFASAEYLTLDLVCGYLGLVAVPLQHNTTPSRLRPIVDEVEPSILAAGVGYLDLAVEAASGSSSLRRLVVFDYQPEVDEQREALQRAQATLAAAGAAVTIETLDEIIERGRALPPEPMYTGDTDQRLAMIMYTSGSTGLPKGAMYTEQMLAKVWTNELMPDFADTPVFNVNFMPLNHLGGRIPLSTAFQAGGTSYFVPESDLSTLFDDWNLVRPTEMGLVPRVAEMLYQRYQSAVDRLVASGADAGSAEARARAELREHVLGGRIVTAFCGTAPLAAEMRAFVETCLDVHVLDGYGLTEVGMVTKDGRMTRPPVLDYKLIDVPELGYFHTDKPYPRGELLVKSLTATPGYFKRPDVTANAFDPDGYYRTGDVMAELEPDRLAYVDRRNNVLKLAQGEFVAVARLEAVFASAPLIRQIFVYGNSERPYLLAVVVPTADAAERFTGDPEGLKAAVAESLRQSAQLAELQSYEVPVDFVVETEPFSEDNGLLSGVGKLLRPKLKERYADRLEQLYAELAENRVTELRALREGADKHPVVFTLTRAAEALLGVAGGPPAPDALFIELGGDSLSALTFSNLLRDIFDVDVPVGMITGPATDLGQLAEYVESERKSGSRRPTFATVHGRGAAEVRAAELTLDKFIDATTLAAAPNLPRATGTPHTVLLTGANGYLGRFLALEWLERLAETGGKLVSIVRATDTAAAVKRLEAVFDSGDPQLLERFRTLAAEHLEVIVGDIGEPNLGLDQATWQRLAQSVDLIVHPAALVNHVLPYDQLFGPNVVGTAELIRLAITTRIKPVTYLSTVAVAMTVDPGEFAEDGDIRAVSAVRPIDDSYANGYANSKWAGEVLLREAHDLCGLPVAVFRSDMILAHSRYAGQLNVPDAFTRLMFSLLTTGIAPTTFYRTDEHGNRAVAHYDGLPADFVAEAVTTLGEQMAAEESGGYRSYDVMNPHDDGVSLDVFVDWLIAAGHDIRRIEDYDEWLGRFTTALRALPDKQRQHSVLPLLDAYREPATPLRGAPAPTDVFRHAVRTAKIGADEDIPHLSAALIDKYVADLRLLGLV

SEQ ID NO: 43 - DNA, 3507 bp, Mycobacterium tuberculosis; identical to SEQ ID NO: 17

SEQ ID NO: 44 - protein, 1168 aa, Mycobacterium tuberculosis; identical to SEQ ID NO: 18

SEQ ID NO: 45 - DNA, 3489 bp, Mycobacterium vanbaalenii
atgtctactgatacccgcgaagaccgccttgcccgccgcatcgccgatctgtacgccaccgacccgcagtttgccgccgcagcacccgacgacgccatctcccacgccatcgatcaaccagggacgcacctgcccgtcatcgtgcagaccgtcctcgacggatacgccgagcggcccgcgctcggacagcgcgcggtccgtttcgtcaccgaccccgccacgggcagaaccaccaccgagctgctcccccgcttcgagaccatcacctacgccgagttgtcacgccgcatccacgcggtcaccgccgcgctgaccgatgtgcatccgggcgaccgcgtggcggtgctgggcttcaccagcatcgactacaccaccgtcgacatggctttggcgatgctgggcgcggtggcggtaccacttcagaccagcgcgccggccaccaccgtccggccgatcgtcgccgagaccgaaccggtggtcatcgcatcgtcggtcgatgccctcaccgacgccgtcggcctggctctcgacgctcccaccgtgacccgccttgtggtcttcgatcatcgcgccggggtcgacgatcatcgcgacgccctcatctccgcgagcgaccggttgcgcgccgccaactcgccgatcgaggtcgagaccattaccgacatcgtcgctcggggttcgaaactgcctgtacgcgcgcaattctcggccgacggtgacgcgctgagcctgctgatctacacctccggcagcaccggcgcacccaagggtgcgatgtacccccaacacctggtcgccaactcatggcggcggttggcccggtccttctggggcgacctgggggtcttcccggcaatcacgctgaacttcatgccgatgagccacgtgatgggccgcggactgctctacggcacgctggacgccggcggcaccgcgtatttcgcggccaggagcgatctgtcgacgttcctggaggatctcgccctggtgcgcccgacgcagctgagcttcgtgccgcggatctgggacaccatccacgccgaggtgtcccaggaactcgagcgccggccgtcggatgcgaccgaggtgatcgccgatctgcggcggagcctgctgggcggccgctacgtcacggcgatgacgggctccgcgccgctgtcaccggagatgcgggccttcgtcgagaacctgctcgacgtgcacctgatcgacgggtacggctcgaccgaggccggcgcggtgttcgtcgacggccgggtccaacgcccgccggtcatcgattacaagctcgtcgacgtcgccgacctcggctacttctccaccgaccgcccccatccgcgcggcgagcttctcgtcaaatccgagacgctgtttcccggctactacaaacgccccgacgtcaccgccgagatgttcgacgaagacggctactaccgcaccggcgacatcgtcgccgagaccggggccgaccagctgacctatctggaccgccgcaacaacgtcctcaaactgtcgcagggcgaattcgtcaccgtctcccgactggaggcagtgttcggcaacagcccgctggtccgccagatctacgtctacggcaacagcgcccgcccctacctgctggctgtggtcgtgcccaccgaagccgcgctggccggtgctgacgccaaagccgctgtggccgagtcacttcaggatgtcgccaaggcgaccgggctgcagtcctacgagatcccccgcgatttccttctcgagacgacgccgttcacgctggagaacggcttgctgaccggcatccgaaaactggcccgccccagactcagagagcgttacggcgaacagctcgaggccctctacaccatgctgtccgaagagcaggccgacgagctgcgggagctgcgccgctccggcggagagcgtccggcgctggaaaccgtcggacgcgccgccggggcgctgctcggcaccaccgcaggcgagctggagccgagcgcccacttcacagatctgggcggggattcgctgtcggcgttgaccttcgccaacctgctgcgcgacatcttcgacgtcgacgtccccgtcggtgtgatcgtcagcccggccaccgatctgcaggcccttgccgactacgtcgagtccgcccgccggcacgggtcggtgcggcccactttcgaatcggtgcacgggcattcgggacgacccgggaccgaggtgcatgcccgcgatctgacgttggacgaattcgtcgacgccgcgaccctggcgcacgcgccgacgttgcccggaccgcgcgccgaggtccgcaccgtcctgctgaccggggcgaccggcttcctcggccggtatctcgctctcgaatggcttgagcggatggcgctggtcggcggcaagctgatctgcctggtccgcgccaaagacgatgcggcagcgcgggttcggctggacagcacgttcgacagcggggacccggagctgctgcggcactaccgacggctggcagccgaccatctcgaagtgatcgccggcgacaaggccgacgccgatctcggactcgacgcgcggacgtggcagcggctcgcggacaccgtcgatctgatcgtcgatcccgccgccctggtcaaccacgtcctgccgtaccgccaactgttcgccccgaacgtgctcggcaccgccgaactgctccgcatcgcgctgacaacgaggatgaagccgttcgtgtacgtgtcgacgatcggcgtcggcgccggtatcgaacccgcgaggttcaccgaggacgccgacatcaggcagatcagcgcgacgcgcagaatcgacgacagctacgccaacggctacggcaacagcaagtgggccggcgaggtgctgctgcgcgaggcgcacgatctgtgcggcctgcccgtttcggtgttccgctgcgacatgatcctggccgacaccacctacgccggtcagctgaacctgccggacatgttcacccgcctgatcttcagcctggtcgccaccggcgtcgcgcccgagtcgttctaccacctcgccaccgacggcacccggcaacgggcccactatgacgggctaccggtggagttcatcgccgaagcgatctcgaccctcggctctgacgtcgcctccgggttccggacgtatcacgtgatgaatccccacgacgacgggataggcctcgacgagtacgtggactggctcatcgacgcaggccatccgattcgacgcgtcggcgactacccgacgtggctgcaacggttcacggtggcgatcaccgcgctgccggaacggcagcggcaggcctcactgttgccgctgctgcacaactaccagcacccggagacgccgatccgcggctccatcgcaccgacagacagattccgtgaagcggtccaggacgccaaaatcggtccggacaaagacattccacacgtgacaccgcagatcgtcatcaagtacgtcaccgacctgcagcgactcggactgctctaa

SEQ ID NO: 46 - protein, 1162 aa, Mycobacterium vanbaalenii
MSTDTREDRLARRIADLYATDPQFAAAAPDDAISHAIDQPGTHLPVIVQTVLDGYAERPALGQRAVRFVTDPATGRTTTELLPRFETITYAELSRRIHAVTAALTDVHPGDRVAVLGFTSIDYTTVDMALAMLGAVAVPLQTSAPATTVRPIVAETEPVVIASSVDALTDAVGLALDAPTVTRLVVFDHRAGVDDHRDALISASDRLRAANSPIEVETITDIVARGSKLPVRAQFSADGDALSLLIYTSGSTGAPKGAMYPQHLVANSWRRLARSFWGDLGVFPAITLNFMPMSHVMGRGLLYGTLDAGGTAYFAARSDLSTFLEDLALVRPTQLSFVPRIWDTIHAEVSQELERRPSDATEVIADLRRSLLGGRYVTAMTGSAPLSPEMRAFVENLLDVHLIDGYGSTEAGAVFVDGRVQRPPVIDYKLVDVADLGYFSTDRPHPRGELLVKSETLFPGYYKRPDVTAEMFDEDGYYRTGDIVAETGADQLTYLDRRNNVLKLSQGEFVTVSRLEAVFGNSPLVRQIYVYGNSARPYLLAVVVPTEAALAGADAKAAVAESLQDVAKATGLQSYEIPRDFLLETTPFTLENGLLTGIRKLARPRLRERYGEQLEALYTMLSEEQADELRELRRSGGERPALETVGRAAGALLGTTAGELEPSAHFTDLGGDSLSALTFANLLRDIFDVDVPVGVIVSPATDLQALADYVESARRHGSVRPTFESVHGHSGRPGTEVHARDLTLDEFVDAATLAHAPTLPGPRAEVRTVLLTGATGFLGRYLALEWLERMALVGGKLICLVRAKDDAAARVRLDSTFDSGDPELLRHYRRLAADHLEVIAGDKADADLGLDARTWQRLADTVDLIVDPAALVNHVLPYRQLFAPNVLGTAELLRIALTTRMKPFVYVSTIGVGAGIEPARFTEDADIRQISATRRIDDSYANGYGNSKWAGEVLLREAHDLCGLPVSVFRCDMILADTTYAGQLNLPDMFTRLIFSLVATGVAPESFYHLATDGTRQRAHYDGLPVEFIAEAISTLGSDVASGFRTYHVMNPHDDGIGLDEYVDWLIDAGHPIRRVGDYPTWLQRFTVAITALPERQRQASLLPLLHNYQHPETPIRGSIAPTDRFREAVQDAKIGPDKDIPHVTPQIVIKYVTDLQRLGLL

SEQ ID NO: 47 - DNA, 3525 bp, Mycobacterium sp.
atgtccaccgagacccgtgaagcgcgcctgcagcagcgcatcgcgcatctgttcaccaccgacccgcagttcgccgccgcccggcccgacccccggatcagcgatgccgtcgaccgcgatgacacgcggctgaccgccatcgtctccgcggtcatgtcggggtacgccgaccggccggcactcgggcagcgcgccgccgaattcgtcaccgacccgcagaccggccgcaccacgatggagctgctcccccgcttcgacaccatcacctaccgggagctgctcgaccgcgtccgggcgctcaccaacgcgtggcacgccgacggggtgcgccccggcgaccgtgtcgcaatcctcggattcaccggcatcgactacaccgtggtcgacctcgccctgatccagctcggcgcggtcgcggtgccgctgcagaccagcgccgccgtggaggcgttgcgcccgatcgtggccgagaccgaaccgatgctcatcgccaccggcgtcgatcatgtcgacgccgccgcggaactcgcactcaccggccaccgtccgtcccgggtggtggtcttcgaccaccgcgagcaggtcgacgacgaacgcgacgcggtgcgggccgcgacggccaggctgggagacgccgtccccgtcgagacactcgccgaggtgttgcggcggggcgcccatctgcccgccgtggcgccgcacgtgttcgacgaggccgatccactgcggctgctgatctacacttccggcagcgccggcgcccccaagggcgcgatgtatcccgagagcaaggtcgccggcatgtggcgcgcgtcggccaaggccgcctggaacaacgatcagacagcgattccgtcgatcaccctgaacttcctgccgatgagccacgtcatgggtcgcggcctgctgtgcggcacgctcagcaccggtggcaccgcgtatttcgccgcccgcagcgatctgtcgacgctgctcgaggacctgcgcctggtacggcccacccaactcagcttcgtgccgcggatctgggacatgctcttccaggagttcgtcggcgaggtcgaccggcgggtgaacgacggtgcggaccgccccaccgcggaggccgacgtgctggccgtacagcgtcacgagctgctcggtggccggttcgtcaccgcgatgaccggttcggcgcccatctccctcgagatgaagacatgggtggagaccctgctcgacatgcacctggtcgagggttacggctcgacggaggccggcgcggtgttcgtcgacggccacatccagcgcccaccggtgctcgactacaaactcgtcgacgtccccgacctcggctacttcagcaccgaccggccgcacccgcgcggtgagctgctggtccgctccacgcagctattccccggctactacaaacgtcccgacgtcaccgccgaggtgttcgacgacgacggcttctaccgcacgggcgacatcgtcgccgaggtcggccccgatcaggtgcagtacctcgaccgccgcaacaacgtgctcaaactcgcccagggtgagttcgtcaccatctccaaactcgaggcggtcttcgccggcagcgccctggtccgccagatctacgtgtacggcaacagtgcgcgctcctacctgctggccgtcgtcgtgccgaccgacgatgcggtggcccggcacgacccggcatcgctcaagaccgcgatcagcgcctcgctgcagcaggccgcgaagaccgccggtctgcagtcctacgagctgccgcgtgacttcctcgtcgagactcaaccgttcacgctggagaacggactactgaccggcatccgcaagctggcgcgcccgaaactcaaggcgcgctacggcgatcggctcgaggcgctctacgtcgaactggtcgaaggacaggcaggcgaattgcgcaccctgcgccgggacggcgcgaagcgtccggtggccgagacggtcggccgcgccgcggccgcgctgctcggcgccgccgccgccgacgtgcgccccgacgcgcacttcaccgacctcggcggagactcgttgtcggcgttgaccttcggcaatctgctgcaggagatcttcggcgtcgacgtcccggtcggggtgatcgtcagcccggcggccgacctggcgtcgatcgcggcgtacatcgaggccgaacaggcctcgaccggtaagcggccgacctacgcgtcggtgcacgggcgcgacgccgaacaggtacacgcgcgcgacctcaccctggacaagttcatcgacgccgaaacactctccgctgcaacagaactgcccggcccgagcggtgaggtgcgcaccgtgctgctgaccggggccaccggattcctcggccgctacctggcgctggactggctcgaacggatggccctggtcgacggcaaggtcatctgcctggtccgcgcgaaggacgatgcggccgcccgcaaacgcctcgacgacaccttcgacagcggcgatccgaagctgctggcgcactaccgcaagctggccgccgaccacctcgaagtgctggccggcgacaagggtgaggcggatctcgggctgccgcatcctgtctggcagcgcctggccgacaccgtcgacctcatcgtcgacccggccgccctggtcaaccacgtactgccgtacagccagctgttcgggcccaacgcgctgggcactgccgagctgatccggcttgcgctcaccacccgcatcaaaccgttcacctacgtgtcgacgatcggcgtcggcgccggtatcgaaccgggccgtttcaccgaggacgacgacatccgggtgatcagcccgacgcgggccgtcgacaccgggtacgccaacggctacggcaacagcaagtgggccggtgaggtgttgttgcgcgaggcgcacgatctgtgcgggctccccgtggcggtgttccggtgcgacatgatcctggccgacaccacctacgccggccagctcaacctgccggacatgttcacccggatgatgctgagcctggtgaccacgggtatcgcgccgaaatcgttccacccactcgacgcaaagggccaccggcagagcgcccactacgacgggctgccggtcgagttcgtcgccgaatcgatctccgcgctgggagcgcaggcggtcgacgaggcgggaacgggtttcgccacctaccacgtgatgaacccccacgacgacgggatcggcctcgacgaattcgtcgactggctcgtcgaggcggggtatcgcatcgaccgcatcgactactacgcggcctggctgcagcggttcgaaaccgccctgcgggcgctgcccgagcgcactcggcagtactcactgctcccgctgctgcacaactaccagcggcctgcgcacccgatcaacggggcgatggccccgaccgaccggttccgcgctgcggtgcaggaggcaaagctcggcccggacaaggacattccccacgtcactccagcggtgatcgtcaagtacgccaccgacctggagctgctgggcctgatctag

SEQ ID NO: 48 - protein, 1174 aa, Mycobacterium sp.
MSTETREARLQQRIAHLFTTDPQFAAARPDPRISDAVDRDDTRLTAIVSAVMSGYADRPALGQRAAEFVTDPQTGRTTMELLPRFDTITYRELLDRVRALTNAWHADGVRPGDRVAILGFTGIDYTVVDLALIQLGAVAVPLQTSAAVEALRPIVAETEPMLIATGVDHVDAAAELALTGHRPSRVVVFDHREQVDDERDAVRAATARLGDAVPVETLAEVLRRGAHLPAVAPHVFDEADPLRLLIYTSGSAGAPKGAMYPESKVAGMWRASAKAAWNNDQTAIPSITLNFLPMSHVMGRGLLCGTLSTGGTAYFAARSDLSTLLEDLRLVRPTQLSFVPRIWDMLFQEFVGEVDRRVNDGADRPTAEADVLAVQRHELLGGRFVTAMTGSAPISLEMKTWVETLLDMHLVEGYGSTEAGAVFVDGHIQRPPVLDYKLVDVPDLGYFSTDRPHPRGELLVRSTQLFPGYYKRPDVTAEVFDDDGFYRTGDIVAEVGPDQVQYLDRRNNVLKLAQGEFVTISKLEAVFAGSALVRQIYVYGNSARSYLLAVVVPTDDAVARHDPASLKTAISASLQQAAKTAGLQSYELPRDFLVETQPFTLENGLLTGIRKLARPKLKARYGDRLEALYVELVEGQAGELRTLRRDGAKRPVAETVGRAAAALLGAAAADVRPDAHFTDLGGDSLSALTFGNLLQEIFGVDVPVGVIVSPAADLASIAAYIEAEQASTGKRPTYASVHGRDAEQVHARDLTLDKFIDAETLSAATELPGPSGEVRTVLLTGATGFLGRYLALDWLERMALVDGKVICLVRAKDDAAARKRLDDTFDSGDPKLLAHYRKLAADHLEVLAGDKGEADLGLPHPVWQRLADTVDLIVDPAALVNHVLPYSQLFGPNALGTAELIRLALTTRIKPFTYVSTIGVGAGIEPGRFTEDDDIRVISPTRAVDTGYANGYGNSKWAGEVLLREAHDLCGLPVAVFRCDMILADTTYAGQLNLPDMFTRMMLSLVTTGIAPKSFHPLDAKGHRQSAHYDGLPVEFVAESISALGAQAVDEAGTGFATYHVMNPHDDGIGLDEFVDWLVEAGYRIDRIDYYAAWLQRFETALRALPERTRQYSLLPLLHNYQRPAHPINGAMAPTDRFRAAVQEAKLGPDKDIPHVTPAVIVKYATDLELLGLI

SEQ ID NO: 49 - DNA, 3522 bp, Mycobacterium avium
atgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccatcacgtacggcgaagtggcgcagcgtgtttcggcgctgggccgcgccctgtccgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccagcaccggcgtggccgtccagacgctggccgagctgctggagcgcggcaaggacctgcccgccgtcggggagccgcccgccgacgaggactcgctggccctgctgatctacacctccgggtccaccggcgcccccaagggcgcgatgtacccgcagagcaacgtcggcaagatgtggcgccgcggcagcaagaactggttcggcgagagcgccgcgtcgatcaccctgaacttcatgccgatgagccacgtgatgggccgaagcatcctctacggcacgctgggcaacggcggcaccgcctacttcgccgcccgcagcgacctgtccaccctgctcgaggacctcgagctggtgcggcccaccgagctcaacttcgtcccgcggatctgggagacgctgtacggcgaattccagcgtcaggtcgagcggcggctctccgagtccggggacgccggcgaacgtcgcgccgtcgaggccgaggtgctggccgagcagcgccagtacctgctgggcgggcggttcaccttcgcgatgacgggctcggcgcccatctcgccggagctgcgcaactgggtcgagtcgctgctcgaaatgcacctgatggacggctacggctccaccgaggccggaatggtgttgttcgacggggagattcagcgcccgccggtgatcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccaacgagctggccgagctgcgccgcaacggtgcccaggcgccggtgctgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtgggcgtcatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgagacgctggccgccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaagctgctcgcgcactaccagcagctggccgccgatcacctggaggtcatcgccggcgacaagggcgaggccaatctgggcctgggccaagacgtttggcaacgactggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctacggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcatcggtctggacgagtacgtcgattggctggtggacgccggctattcgatcgagcggattgccgactactccgaatggctgcggcggttcgagacctcgctgcgggccctgccggaccggcagcgccagtactcgctgctgccgctgctgcacaactaccgcacgccggagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctga

SEQ ID NO: 50 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYGEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVGEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSESGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGIGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 51 - DNA, 3525 bp, Mycobacterium sp.
atgtccaccgagacccgtgaagcgcgcctgcagcagcgcatcgcgcatctgttcgccaccgacccgcagttcgccgccgcccggcccgacccccggatcagcgatgccgtcgaccgcgatgacgcgcggctgaccgccatcgtctccgccgtcatgtcggggtacgccgaccggccggcactcgggcagcgcgccgccgaattcgccaccgacccgcagaccggccgcaccacgatggagctgctcccccgcttcgacaccatcacctaccgggagctgctcgaccgcgtccgggcgctcaccaacgcgtggcacgccgacggggtgcgccccggcgaccgcgtcgcaatcctcggattcaccggcatcgactacaccgtcgtcgacctcgccctgatccagctcggcgcggtcgcggtgccgctgcagaccagcgccgccgtggaggcgctgcgcccgatcgtggccgagaccgaaccgatgctcatcgccaccggcgtcgatcatgtcgacgccgccgcggaactcgcactcaccggccaccgtccgtcccaggtggtggtcttcgaccaccgcgagcaggtcgacgacgaacgcgacgcggtgcgggccgcgacggcccggctgggagacgcggtgcccgtcgagacactcgccgaggtgttgcggcgtggcgcccatctgcccgccgtggcaccgcacgtgttcgacgaggccgatccactgcggctgctgatctacacctccggcagcaccggcgcccccaagggcgcgatgtatcccgagagcaaggtcgccggcatgtggcgcgcgtcggccaaggccgcctggaacaacgatcagacggcgattccgtcgatcaccctgaacttcctgccgatgagccacgtcatgggtcgcggcctgctgtgcggcacgctcagcaccggtggcaccgcgtatttcgccgcccgcagcgatctgtcgacgctgctcgaggacctgcgcctggtacggcccacccaactcagcttcgtgccacggatctgggacatgctcttccaggagttcgtcggcgaggtcgaccggcgggtgaacgacggtgcagaccgccccaccgcggaggccgacgtgctggccgaactgcgccaggagctgctcggtggccggttcgtcaccgcgatgaccggttcggcgcccatctcccccgagatgaagacatgggtggagaccctgctcgacatgcacctggtcgagggttacggctcgacggaggccggcgcggtgttcgtcgacggccacatccagcgcccgccggtgctcgactacaaactcgtcgacgtccccgacctcggctacttcagcaccgaccggccgcacccgcgcggtgagctgctggtccgctccacgcagctgttccccggctactacaagcgtcccgacgtcaccgccgaggtgttcgacgacgacggcttctaccgcacgggcgacatcgtcgccgagctcggccccgaccagctgcagtacctcgaccgccgcaacaacgtgctcaaactcgcccagggtgagttcgtcaccatctccaaactcgaggcggtcttcgccggcagcgccctcgtccgccagatcttcgtgtacggcaacagtgcgcgctcctacctgctggccgtcgtcgtgccgaccgacgatgcggtggcccggcacgacccggcatcgctcaagaccgcgatcagcgcctcgctgcagcaggccgcgaagaccgccggtctgcagtcctacgagctgccgcgtgacttcctcgtcgagactcaaccgttcacgctggagaacggactactgaccggcatccgcaagctggcccgcccgaaactcaaggcgcgctacggcgatcggctcgaggcgctctacgtcgaactggccgaaggacaggcaggcgaactgcgcaccctgcgccgggacggcgcgaagcgtccggtggccgagacggtcggccgcgccgcggccgcgctgctcggcgccgccgccgccgacgtgcgccccgacgcgcacttcaccgacctcggcggagactcgttgtcggcgttgaccttcggcaatctgctgcaggagatcttcggcgtcgacgtcccggtcggggtgatcgtcagcccggcggccgacctggcgtcgatcgcggcgtacatcgagaccgaacaggcctcgaccggcaagcggccgacctacgcgtcggtgcacgggcgcgacgccgaacaggtacgcgcgcgcgacctcaccctggacaagttcatcgacgccgaaacactctccgctgcaacagaactgcccgtcccgatcggtgaggtgcgcaccgtgctgctgaccggggccaccggattcctcggccgctacctggcgctggactggctcgaaaggatggccctggtcgacggcaaggtcatctgcctggtccgcgcgaaggacgatgcggccgcccgcaaacgcctcgacgacaccttcgacagcggcgatccgaagctgctggcgcactaccgcaagctggccgccgaccacctcgaagtgctggccggcgacaagggtgaggcggatctcgggctgccgcatcaggtctggcagcgactggccgacaccgtcgacctcatcgtcgacccggccgccctggtcaaccacgtactgccgtacagccagctgttcgggcccaacgcgctgggcactgccgagctgatccggcttgcgctcaccacccgcatcaaaccgttcacctacgtgtcgacgatcggcgtcggcgccggtatcgaaccgggccgtttcaccgaggacgacgacatccgggtgatcagcccgacgcgggccgtcgacaccgggtacgccaacggctacggcaacagcaagtgggccggtgaggtgttgttgcgcgaggcgcacgatctgtgcgggctccccgtggcggtgttccggtgcgacatgatcctggccgacaccacctacgccggccagctcaacctgccggacatgttcacccggatgatggtgagcctggtgaccacgggtatcgcgccgaagtcgttccacccactcgacgcaaagggccaccggcagcgcgcccactacgacgggctgccggtcgagttcgtcgccgaatcgatctccgcgctgggagcgcaggcggtcgacgaggcgggaacgggtttcgccacctaccacgtgatgaacccccacgacgacgggatcggcctcgacgaattcgtcgactggctcgtcgaggcggggtatcgcatcgaccgcatcgacgactacgcggcctggctgcaacggttcgaaaccgcgctgcgggcgctgcccgagcgcactcggcagtactcactgctcccgctgctgcacaactaccagcggcctgcgcacccgatcaacggggcgatggccccgaccgaccggttccgcgccgcggtgcaggaggcaaagctcggcccggacaaggacattccccacgtcacccccggggtgatcgtcaagtacgccaccgacctggaactgctggggctgatctag

SEQ ID NO: 52 - protein, 1174 aa, Mycobacterium sp.
MSTETREARLQQRIAHLFATDPQFAAARPDPRISDAVDRDDARLTAIVSAVMSGYADRPALGQRAAEFATDPQTGRTTMELLPRFDTITYRELLDRVRALTNAWHADGVRPGDRVAILGFTGIDYTVVDLALIQLGAVAVPLQTSAAVEALRPIVAETEPMLIATGVDHVDAAAELALTGHRPSQVVVFDHREQVDDERDAVRAATARLGDAVPVETLAEVLRRGAHLPAVAPHVFDEADPLRLLIYTSGSTGAPKGAMYPESKVAGMWRASAKAAWNNDQTAIPSITLNFLPMSHVMGRGLLCGTLSTGGTAYFAARSDLSTLLEDLRLVRPTQLSFVPRIWDMLFQEFVGEVDRRVNDGADRPTAEADVLAELRQELLGGRFVTAMTGSAPISPEMKTWVETLLDMHLVEGYGSTEAGAVFVDGHIQRPPVLDYKLVDVPDLGYFSTDRPHPRGELLVRSTQLFPGYYKRPDVTAEVFDDDGFYRTGDIVAELGPDQLQYLDRRNNVLKLAQGEFVTISKLEAVFAGSALVRQIFVYGNSARSYLLAVVVPTDDAVARHDPASLKTAISASLQQAAKTAGLQSYELPRDFLVETQPFTLENGLLTGIRKLARPKLKARYGDRLEALYVELAEGQAGELRTLRRDGAKRPVAETVGRAAAALLGAAAADVRPDAHFTDLGGDSLSALTFGNLLQEIFGVDVPVGVIVSPAADLASIAAYIETEQASTGKRPTYASVHGRDAEQVRARDLTLDKFIDAETLSAATELPVPIGEVRTVLLTGATGFLGRYLALDWLERMALVDGKVICLVRAKDDAAARKRLDDTFDSGDPKLLAHYRKLAADHLEVLAGDKGEADLGLPHQVWQRLADTVDLIVDPAALVNHVLPYSQLFGPNALGTAELIRLALTTRIKPFTYVSTIGVGAGIEPGRFTEDDDIRVISPTRAVDTGYANGYGNSKWAGEVLLREAHDLCGLPVAVFRCDMILADTTYAGQLNLPDMFTRMMVSLVTTGIAPKSFHPLDAKGHRQRAHYDGLPVEFVAESISALGAQAVDEAGTGFATYHVMNPHDDGIGLDEFVDWLVEAGYRIDRIDDYAAWLQRFETALRALPERTRQYSLLPLLHNYQRPAHPINGAMAPTDRFRAAVQEAKLGPDKDIPHVTPGVIVKYATDLELLGLI

SEQ ID NO: 53 - DNA, 288 bp, Mycobacterium leprae
atgagcaccgtggatggtgtgtgtgatgaagacatatattactattatgactgcatatattgcgctgccgatgttgccagcccgactgggtatttacccggaggactctttagcttggcgaagctgcttgttatacgtggggagaagcagtatgtcttcggcctgaatgactcgacgagtgtcggccccgggccgggcaacatgccctggctggacgacccaggcctgtctgctgtcattgcgagttccgtcgcagcggctgaattggctgctgcgcgatcctggtaa

SEQ ID NO: 54 - protein, 95 aa, Mycobacterium leprae
MSTVDGVCDEDIYYYYDCIYCAADVASPTGYLPGGLFSLAKLLVIRGEKQYVFGLNDSTSVGPGPGNMPWLDDPGLSAVIASSVAAAELAAARSW

SEQ ID NO: 55 - DNA, 3396 bp, Clavibacter michiganensis
atgagcactgagcagatgggcaccgagcagatggggagccagcacgaggacacgtcgatcgaggcgatcttcgcgcagcacgccgaccggacggcgctgcggcagcgatccgggccggacatcacggacatgggcttccgggagctgtgggaccgggcgggcgcgctggccgcggcgctcggcgagaccgtgtccgccggagaccgcatcgcggtgctcggcacggcgaccgcggacgccgtcacgctcgacctcgccgcgtggatcctcggcgcggtgagcgtgcccctccaggcgagcgcgcccgtcgcggccctgcgcgcgatcgtcgaggagacgacgccggtgtggatcgcggccaccgccgaccaggccgcgacggcccgggcggtcgccgaggcatcgggcgacggcatccggacgatgcggctcgacaccgacaccgacgcggacaccgacaccgacgccgccctgacgctcggcgcgctcgtcgcccgcggggccggcctgcgtcgccggagcccgtggcaccccgcacccggcgacgacccgctcgcgctcctgctctacacgtcgggcagcacgggcacgccgaagggcgcgatgtacacgcgctccatggtcgagcggatgtggcacgccctccggcccgaccccgccgcgcccgccgacgcatccacgaccgcggacgacggagacgccgcagccatcgtcgggtacgcgtacctccccatgagccacctcaccggccgctcctccctgctcgccacgctcggccgcggcggcacggtcgcgctcgcgacctcgaccgacctgtcgacgctcttcgacgacctgcggaccttcgccccgaccgagttcgtcttcgtgccgcgcgtcgcggagctggtgcggcaggagggcgaccgcgaggagcagcgccgactcaccgccggcagcacggaccgggacgcggtccgcgccgaggtccaggccgacctgcgcgcccgcgcgttcggcggacggatccaccgggcgatctgcaccagcgcaccgctgacgccggagctccgcacgtacatcgagggatgcctcgggctgacgctgcacgacctgtacgggtcgaccgaggccggcggcatcctccacgacggggtgatccagcagcctcccgtcaccgagcacaagctcgtcgacgtccccgagctcgggtaccgcaccaccgaccgcccgcacccgcggggcgagctgctcgtcaagagcgcctccgtgatcgccgggtacttccgccggccggacgtcaccgccgcggtgttcgacgaggacggcttctaccggaccggcgacgtcatggcgcagaccggacccggcacctacgagtacgtcgaccgtcggaacaacgtgatcaagctgtcgcagggcgagttcgtcgcggtggcatcgctcgaggcgacgtacggcgggacgcccgaggtgcaccagatcgcgctgcacggcgacagccggcacgcgttcctcgtcgcggtcgtcgtcccggcggaccccgcggcgtcggagcgcgacatcctcgcggccctccagcgcaccgcccgcgagcacggcctcgccccctacgaggtgccccgcggcgtgatcgtcgaaccggatccgttcacggtcgacggcggcatgctctccgacgccggcaagctcctgcgcctgcgcctcacgcagcggtacggcgagcgcctcgccgccctctacgacgcgctcgaggagcagcagagcggcaccctcgtcgccgcgctccgcgaacgcgccgacgacgagccgacggtcgacacggtggtgcgcgccgccctcctgctcctcggggccgaggtgtcccccgcgaccgccgccgctgcccggttctccgacctcggcggcgactcgctgtccgcgctgacgttctccgggatcctcgaggacgtcttcggcaccgaggtgcccgtcggcgtcctcaccgacccgaccaacgacctcgccgccgtcgccgcctacgtggagcgctccgcctccgacgaccggccgaccgtgacccgcgtgcacggcgccggcgcatccaccctccgcgtgggcgacctccggctcgaccggatgctcggcggcatcccgacgccggtcccccgggcctcggccgcccggccgggatcccgcacggtcctgctcaccggcgcgaacggctacctcggccggttcctggccatcgactggctcgagcgcctcgctgcgacgggcggcacgctggtgtgcatcgtgcgcggcgccgacgacgccgacgcccggcgccgcctcgaggccgcgttcgccgcggatcccgcgttcgcccggcgcttcgccgagctgtcgggctcgctcgaggtgctggccggagacgtcagcgagcaccgcctcggcctcgacgacgagcggtggatcgacctggccgcgcgggtcgacctcgtcgcgcacgcggctgccctcgtgaaccacgtcctcccgtactcggcgctgttcggtccgaacgtcgtcggcaccgccgaggcgatccgcctggcgatcgccgccggcagcgtgcccgtcaccttcgtctcgagcgtcgcggtcgcgggcggcgcgcggccgggcgcgaccgccgacgccgagccgtcggcgcccggcgcgctcgacgagcacgccgacatccgcgccacgatccccgagtgggccgtcggcgacgagtacgccaacgggtacggcgcgagcaagtgggcgagcgaggtgctgctccgcgaggcgcacgagcaccacggcgtccccgtggccgtgttccgctccgacatgatcctggcgcacccccgctggcgcggtcaggtgaacctccccgacgtcttcacccggctgatctggagcgtgctcaccaccggcctcgcccccgcatcgttcgtgaggcgcggccccgacggcgagcggcagcggtcgcactacgacgggctgccggccgacttcacggcggcggcgatcgacgggatcggcgcggcgctcaccgaggggcaccgcaccttcaacgtcgtgaacccccacgacgacggcgtctcgctcgacaccttcgtcgactggatccgcgaggacggccacgacatcgcgcgcgtggacgaccacgcggagtgggtcgaccggttccgcgcggcgctgggagcgctcccggacgcggaccgcgcccggtccgtcctgccgctgatgcacgcgttcgcctcgcccgaggagccgcacgccggctcggcgatcccggcggatgcgttcgccgaggccgtccgcgcggtgcgcccgctcgggtcgccggacatcccgtctctcgaccacgcgctcatcgccaaggtcgccgacgacctcgcgttcctggggctgctcgcgccggcgcgggcggcggctgcctga

SEQ ID NO: 56 - protein, 1131 aa, Clavibacter michiganensis
MSTEQMGTEQMGSQHEDTSIEAIFAQHADRTALRQRSGPDITDMGFRELWDRAGALAAALGETVSAGDRIAVLGTATADAVTLDLAAWILGAVSVPLQASAPVAALRAIVEETTPVWIAATADQAATARAVAEASGDGIRTMRLDTDTDADTDTDAALTLGALVARGAGLRRRSPWHPAPGDDPLALLLYTSGSTGTPKGAMYTRSMVERMWHALRPDPAAPADASTTADDGDAAAIVGYAYLPMSHLTGRSSLLATLGRGGTVALATSTDLSTLFDDLRTFAPTEFVFVPRVAELVRQEGDREEQRRLTAGSTDRDAVRAEVQADLRARAFGGRIHRAICTSAPLTPELRTYIEGCLGLTLHDLYGSTEAGGILHDGVIQQPPVTEHKLVDVPELGYRTTDRPHPRGELLVKSASVIAGYFRRPDVTAAVFDEDGFYRTGDVMAQTGPGTYEYVDRRNNVIKLSQGEFVAVASLEATYGGTPEVHQIALHGDSRHAFLVAVVVPADPAASERDILAALQRTAREHGLAPYEVPRGVIVEPDPFTVDGGMLSDAGKLLRLRLTQRYGERLAALYDALEEQQSGTLVAALRERADDEPTVDTVVRAALLLLGAEVSPATAAAARFSDLGGDSLSALTFSGILEDVFGTEVPVGVLTDPTNDLAAVAAYVERSASDDRPTVTRVHGAGASTLRVGDLRLDRMLGGIPTPVPRASAARPGSRTVLLTGANGYLGRFLAIDWLERLAATGGTLVCIVRGADDADARRRLEAAFAADPAFARRFAELSGSLEVLAGDVSEHRLGLDDERWIDLAARVDLVAHAAALVNHVLPYSALFGPNVVGTAEAIRLAIAAGSVPVTFVSSVAVAGGARPGATADAEPSAPGALDEHADIRATIPEWAVGDEYANGYGASKWASEVLLREAHEHHGVPVAVFRSDMILAHPRWRGQVNLPDVFTRLIWSVLTTGLAPASFVRRGPDGERQRSHYDGLPADFTAAAIDGIGAALTEGHRTFNVVNPHDDGVSLDTFVDWIREDGHDIARVDDHAEWVDRFRAALGALPDADRARSVLPLMHAFASPEEPHAGSAIPADAFAEAVRAVRPLGSPDIPSLDHALIAKVADDLAFLGLLAPARAAAA

SEQ ID NO: 57 - DNA, 3498 bp, Salinispora arenicola
gtgaccaccacggagcagaccctcaccgagcggctcatcgccgaggacgagcagatccggcgggcccaggtcagcgccgaagtctccgccgcgatgcgggtgccgggcatgtcgcaggcccagatcgtggccgccggattcaccggttacgccgaccgcgccgccctgggtgagcgcgcccgcgaagccgtcaccgacccggtcaccggccgcaccacccaccggcttctgccatggttcgacaccatcacctacggcgaggtccggtcgcgggtgctggcgatctccgccgcctggtggcacgacgtggacgctccactccgtcccggcgccttcgtcgtttcggtcggcgtccccagcgccgacctcgtgacggtcgagctcgcggtgctacacaccggcgcggtcagtgtgccactgcaggtcagctccaccgccgagcaactgcgcccgatcctcgacgaggccgccccgctcatcgtggccacgagcgtggaccggctcgctgtggtgaccgcggcgatgtcgggcaacgcgtcggtgcgccggatcatggtcctgaaccacgacgcagcgatcaccgcccaccgggatgccgtggacgccgcgcgatcggcgctcgccggcaccgcagtcgtcgtgcacacattgaccgaggtgttggaccgtggacggggcctgcccgcccctgagccctacgcggcgcccacgggggaggatcccctgtcgctgttgatctacacctcgggcagtaccggtacgcccaagggcgcaatgtttccggagagcatgacccgcgccaactgggtgcgtttcgaccccaagccgaccgacatggcggtcatccggctcaactacctgccgctgagccacaacgtcggccgcatcgtgctgttcgaggcgctcgcggtgggcggcatcgccttcttcaccgcacacagtgacctgtccacgctcctggaggacatggccctcgcccggcccaccgacctgttccttatcccgcggctgtgcgacatgctcgcccagcgccacgacagcgaactggcccgccgccgcatcaccaccgcggatcacgagggggtccgacaggtccacacccatctgcgcgaggctgtcctcggcggcagggtgacccgcgcgatgtcgctgtccgcgccgctgagcccacagctgcgtcggttcgtggagtcgtgtctcggcttcgcggtgcacgatgtcttcgggtcgaccgaggccggcgggctgctcgtcaacggccgggtgctgcgcccgccggtgctcgactatcgcttggtcgacgtccccgacctcggctacttcaccaccgaccgtccgtaccctcgcggggagctgctggtgcggaccgcgacgatcatccccggctactaccagcggcccgagctcaacgccgagctgttcaccgaggacggctactaccgcaccggcgacatcatggccgagtacggccccgaccacctcggctatgtcgaccgcaccacgagcgtgctgaagctgtcacagggcgagttcgtggccgtgtcacggttggaggaactgttcgccgcctccccgctgatccggcagatctacctgtacggcaacagcgagcggccgtacctgctcgccgtggtcgtgcccacggaggaggcgcacgccgccacccgggaacccgcggcgctcaaggcggtgctcggcgagtcgctgcaacgcatcgctcagcagcacggcctgcacccgtacgaggtgccgcgcgacctcctcatcgagaccaccccgttcagcaccgccaacggtctgctctccgacatccgtaagcccctgcgtccgaagctcaagacccggtacgctcctcgactcgaagcgctctacaccgagctcgccgagcgcgaggccgaccggatccgcacgctgcgcgacgccggttccgcgcaacccgtgctgcccgcgttgcgcgaggctgcccgggcgttcctcggccgcccaggcgcagcgctcgacgtgaacgaccgctttgtggacctcggcggcgactccctgtcggccctggccctgtcgaacctgctgagcgacatcttcgaggtccgcgtcccggtcggcatcatgatcagcgcgaccggcacgctcggttccgtggcggcctggatcgaggccgagcgtgccaccgccggagcgggtatcggccgcgcgacgcccacctccgtgcacggtgcgaacctcacccaggtacacgccgatgacctgaccctcggcacgttcctcgacgtgacgaccctcgccgccgctgcctgcctgccccgggcgccgctgtccgacccgcgcgtggtgctgctgacgggtgcgaccggctatctgggccggttcctggccctcgagtggctggaccgcctttcccgtagcggcgggacgctcgtgtgcgtggtgcgcgccgccgacgatgcggaagccgcgcgccgcctggaaagtgtctatggctccagcgaccccgagttgctggagcgcttccgttcactcgccggccacgtgcgcgtgttggccggcgatgttgccgaagccaggttcggcctgccggccggggtgtggcaggaactggccgaaacggtggacctgatcgtgcactccgcggcactggtcaaccacgttctcccgtacgaacagctgttcgggcccaacgtggcgggaacggcggaactggtgcgcctcgccgtcagcgtacgggtgaagggaattgcctttctctccaccgttgccgtgatcacctcgcagaccacgacacccgacgaggacgcggacatccggcaggcgagcccgcaccgggtgctcgacgacagctacgcgaacggctacgcggccagcaagtgggcaggtgaggtgctcctgcgacgcgcccacgaggagtacggcgtgccggtcagcgtgttccgctcggacgtcatcctggcccactcccgctacgccgggcagctcaacgtcccggatatgttcacgcgcctgctcctgagcatcctggcgaccggtattgccccagcgtcgttttatcgcaccggcccggacggcgaacgccagccggcgcactacgacggtctcccggtcgacttcaccgcggcggccgtagccgcggtgggtgtcaccgagggacaccgcaccttcaacgtactgaatccacacgaggacggcatcgggctggatacctttgtggactggctcgtggcagccggacacccggtgcagcgcatcgcggaccacgacgagtgggtgacccgcttcgccacggccatgcgtgggctgcctgaacgccagcgccgcagctcgatcctgccgctcctacacgcctttgccgagcccgctccgccgaccttcggatccagactgccgacggaccggtttcgcgccgccgtgaaagccgccaacgtggtccccggcaacgagatcccgcacctcgatgcggccctcgtcaccaagtacgccgacgacctcaggctgctcgaccttctctga

SEQ ID NO: 58 - protein, 1165 aa, Salinispora arenicola
VTTTEQTLTERLIAEDEQIRRAQVSAEVSAAMRVPGMSQAQIVAAGFTGYADRAALGERAREAVTDPVTGRTTHRLLPWFDTITYGEVRSRVLAISAAWWHDVDAPLRPGAFVVSVGVPSADLVTVELAVLHTGAVSVPLQVSSTAEQLRPILDEAAPLIVATSVDRLAVVTAAMSGNASVRRIMVLNHDAAITAHRDAVDAARSALAGTAVVVHTLTEVLDRGRGLPAPEPYAAPTGEDPLSLLIYTSGSTGTPKGAMFPESMTRANWVRFDPKPTDMAVIRLNYLPLSHNVGRIVLFEALAVGGIAFFTAHSDLSTLLEDMALARPTDLFLIPRLCDMLAQRHDSELARRRITTADHEGVRQVHTHLREAVLGGRVTRAMSLSAPLSPQLRRFVESCLGFAVHDVFGSTEAGGLLVNGRVLRPPVLDYRLVDVPDLGYFTTDRPYPRGELLVRTATIIPGYYQRPELNAELFTEDGYYRTGDIMAEYGPDHLGYVDRTTSVLKLSQGEFVAVSRLEELFAASPLIRQIYLYGNSERPYLLAVVVPTEEAHAATREPAALKAVLGESLQRIAQQHGLHPYEVPRDLLIETTPFSTANGLLSDIRKPLRPKLKTRYAPRLEALYTELAEREADRIRTLRDAGSAQPVLPALREAARAFLGRPGAALDVNDRFVDLGGDSLSALALSNLLSDIFEVRVPVGIMISATGTLGSVAAWIEAERATAGAGIGRATPTSVHGANLTQVHADDLTLGTFLDVTTLAAAACLPRAPLSDPRVVLLTGATGYLGRFLALEWLDRLSRSGGTLVCVVRAADDAEAARRLESVYGSSDPELLERFRSLAGHVRVLAGDVAEARFGLPAGVWQELAETVDLIVHSAALVNHVLPYEQLFGPNVAGTAELVRLAVSVRVKGIAFLSTVAVITSQTTTPDEDADIRQASPHRVLDDSYANGYAASKWAGEVLLRRAHEEYGVPVSVFRSDVILAHSRYAGQLNVPDMFTRLLLSILATGIAPASFYRTGPDGERQPAHYDGLPVDFTAAAVAAVGVTEGHRTFNVLNPHEDGIGLDTFVDWLVAAGHPVQRIADHDEWVTRFATAMRGLPERQRRSSILPLLHAFAEPAPPTFGSRLPTDRFRAAVKAANVVPGNEIPHLDAALVTKYADDLRLLDLL

SEQ ID NO: 59 - DNA, 3555 bp, Mycobacterium abscessus
atgaccgtgaccaacgaaaccaacccacagcaggagcagctatcccgccgtattgaaagtctgcgcgaaagcgatccgcagttccgggcggcccagcccgacccggcggtcgccgaacaggtgctgcgcccgggcctgcatctttctgaagccattgcggcgttgatgactggatacgctgagcgcccggcgctcggtgagcgcgcacgcgagttggtcaccgaccaggatggccgcaccacgctgcgcctgttgccacgcttcgacaccaccacatacggcgaattatggtcccgcacaacatcagtcgccgctgcatggcaccacgacgccgcccacccggttaaggccggcgatctggtggccaccctgggattcaccagcatcgactacaccgtgctggatctggcgatcatgatcctcggtggcgtggcggttccgctacagaccagcgccccggcttcgcagtggacgaccattctggccgaagcggaacccaacactcttgcggtaagcatcgaattgatcggcgctgcaatggaatctgtgcgggccacgccttccatcaagcaggtcgtcgtgttcgactacacccccgaggtcgatgatcaacgggaggcattcgaggcagcaagcacacaactcgccggcaccggcatcgccattgagaccctcgatgccgtcatcgcccgcggcgccgcacttccggccgcaccgctctacgcaccatcggccggcgacgatccgctggcgctgctcatctacacctccggcagcaccggggctccaaagggcgccatgcacagcgaaaacatcgtgcgccgctggtggattcgtgaggacgtcatggccggcaccgagaacctgcccatgatcgggctgaacttcatgccgatgagtcacatcatgggacgcggcaccctcacctccaccctgtctaccggtggaaccggatacttcgcggcgtccagtgacatgtcaacgctcttcgaggacatggagctgatccgcccgacggccctggccttggttccacgcgtgtgcgacatggtgttccagcgattccagaccgaggtggaccggcgtctggcgagcagcgacaccgccagtgccgaggccgttgcggccgaggtcaaggccgatatccgtgacaacctcttcggtggccgcgtatcggcggtcatggtcggttctgctccgttgtccgaggagctgggtgagttcatcgaatcctgcttcgagctgaatctgaccgatggctacggctccaccgaagccggcatggtgttccgcgacggcatcgtgcaacgcccgccggtcattgactacaagctggttgacgtgcccgaactgggctacttctccaccgacaagccgcacccgcgcggtgagctgctgctgaagaccgacggcatgttcctcgggtactacaaacgccccgaggtgactgccggcgtcttcgacgcggacggtttttacatgaccggcgacatcgtcgccgagctggcccacgacaacatcgagatcatcgatcgccgcaacaacgtgctcaaactctcacagggagagtttgtcgcggtcgccaccttggaggccgagtacgccaatagccctgtggtgcaccagatctacgtctacggcagcagcgaacggtcctacctgctagcagtcgtggtgccgacgccggaggccgtggccgccgccaagggcgacgcggcggcactcaagacgaccatcgcggactcgctgcaggacattgccaaggagatccagctgcagtcctacgaagtcccccgtgacttcatcatcgaaccgcagccattcacccagggcaacggcctgctgacgggtatcgccaagctggcgcgtccgaacctgaaggcgcactatggaccgcggctggagcagatgtacgccgaaatcgccgagcagcaggctgccgagcttcgggcgttgcacggagtggacccagacaagcccgcgctggaaacggtcctcaaggcggcgcaggccctgctcggcgtctcgtcggccgaactggccgcggacgcgcatttcaccgatctaggtggcgattcgctgtccgcactgtccttctcggatctgctgcgcgatatcttcgcggtcgaagtaccggtcggagtcatcgtcagtgccgcaaacgatctcagcggtgttgcgaaatttgttgatgaacaacgctattcgggcgggacgcggccgaccgcggagacggtgcacggcgccgggcatacggagatccgggccgcggacctgaccctggataagttcatcgacgaggccaccctgcatgcggcaccgtcgcttccgaaggccgtcgggatcccacacaccgtcctgctcaccgggtccaacggctacctgggccactacctggcactggaatggcttgagcgcctggacaagacagaaggcaagctgatcgccatcgtccgcggtaagaatgccgaggccgcctaccgccgcctcgaggaagccttcgacaccggcgacacgcagctgttggcgcacttccggtcgctggccgacaagcacctcgaagtactggccggcgatatcggcgaccccaaccttggcctggatgccgacacctggcagcgcctggccgacaccgtcgacgtcatcgtgcaccccgccgccctggtcaaccacgtactgccctacagccagctgttcggaccgaatgtcgtcggcaccgccgagatcatcaagctggccatcactaccaagatcaagccggtcacctacctgtccacggtcgcggtcgcggcatatgtcgatccgacgacattcgacgaagagtccgatatccggctcatcagcgcggtgcgtcccgtggacgagctgtacgcgaacggctacggcaacagcaagtgggccggcgaggtactgctgcgcgaagcccacgatctgtgcggactacccgtcgcggtcttccgctccgacatgatcttggcccacagccgctacaccggacagctcaacgtgcccgaccagttcacccgactaatcctcagcctcatcgccaccggaatcgcacccggctccttctaccaagcacacgccaccggcgaacgcccactcgcccactacgacgggctacccggtgacttcaccgccgaggcgatcaccacgttgggcacccaggtggtcgacagctacgagacctacgactgcgtgaacccgcatgcagacggagtctcgctggacaacttcgtcgactggctcatcgaagccggctaccccatcgcacgcatcgacaactacaccgaatggttcacccgcttcgacaccgccatccgaagcctccccgaaaaacagaaacaacactccctactaccactgctccacgcattcgaacagccgtccgccgccgagaaccacggcgtcgtcccggcaaagcgtttccagcacgctgtgcaggccgccggaatcggtccggccgggcaagacggcactaccgacattccccacctgtcgcggcggctgatcgtgaaatacgccaaggacctcgaacagctcggactcctatga

SEQ ID NO: 60 - protein, 1184 aa, Mycobacterium abscessus
MTVTNETNPQQEQLSRRIESLRESDPQFRAAQPDPAVAEQVLRPGLHLSEAIAALMTGYAERPALGERARELVTDQDGRTTLRLLPRFDTTTYGELWSRTTSVAAAWHHDAAHPVKAGDLVATLGFTSIDYTVLDLAIMILGGVAVPLQTSAPASQWTTILAEAEPNTLAVSIELIGAAMESVRATPSIKQVVVFDYTPEVDDQREAFEAASTQLAGTGIAIETLDAVIARGAALPAAPLYAPSAGDDPLALLIYTSGSTGAPKGAMHSENIVRRWWIREDVMAGTENLPMIGLNFMPMSHIMGRGTLTSTLSTGGTGYFAASSDMSTLFEDMELIRPTALALVPRVCDMVFQRFQTEVDRRLASSDTASAEAVAAEVKADIRDNLFGGRVSAVMVGSAPLSEELGEFIESCFELNLTDGYGSTEAGMVFRDGIVQRPPVIDYKLVDVPELGYFSTDKPHPRGELLLKTDGMFLGYYKRPEVTAGVFDADGFYMTGDIVAELAHDNIEIIDRRNNVLKLSQGEFVAVATLEAEYANSPVVHQIYVYGSSERSYLLAVVVPTPEAVAAAKGDAAALKTTIADSLQDIAKEIQLQSYEVPRDFIIEPQPFTQGNGLLTGIAKLARPNLKAHYGPRLEQMYAEIAEQQAAELRALHGVDPDKPALETVLKAAQALLGVSSAELAADAHFTDLGGDSLSALSFSDLLRDIFAVEVPVGVIVSAANDLSGVAKFVDEQRYSGGTRPTAETVHGAGHTEIRAADLTLDKFIDEATLHAAPSLPKAVGIPHTVLLTGSNGYLGHYLALEWLERLDKTEGKLIAIVRGKNAEAAYRRLEEAFDTGDTQLLAHFRSLADKHLEVLAGDIGDPNLGLDADTWQRLADTVDVIVHPAALVNHVLPYSQLFGPNVVGTAEIIKLAITTKIKPVTYLSTVAVAAYVDPTTFDEESDIRLISAVRPVDELYANGYGNSKWAGEVLLREAHDLCGLPVAVFRSDMILAHSRYTGQLNVPDQFTRLILSLIATGIAPGSFYQAHATGERPLAHYDGLPGDFTAEAITTLGTQVVDSYETYDCVNPHADGVSLDNFVDWLIEAGYPIARIDNYTEWFTRFDTAIRSLPEKQKQHSLLPLLHAFEQPSAAENHGVVPAKRFQHAVQAAGIGPAGQDGTTDIPHLSRRLIVKYAKDLEQLGLL

SEQ ID NO: 61 - DNA, 3552 bp, Mycobacterium abscessus
atgacgatcgacgccaccgcggacaacaccaaggaagcacgtcgtcagcggttaggcgaccgcatcaggcgcctattcaccgacgatgagcagttccgtgccgccaagcccgataccgcggttgataccgccgtcgcccagcctggtctgcgtctcgcccaggtggtcgccacgatcatgaacgggtacgcggaccgtccggcgctcgggcaccgagtccaggagctcgtcgccgacgccgccggccgttcgacgctgcgcccgttgcccgagttcgagacggtcacctacggagagctgtggggcatggcccgcgcgttggcctccacctggtaccacgatcccgccgctccggtacgggccggggacttcgtcgcgatgctcggcttcaccagcgtggactacaccgctgtcgacttggcatgcatccaccttggcgcggtggcggttccattgcagaccagcgcatcggcatccaactggaccgcgatcctggccgaatcggaacctgccgtcctggcggtaagcgccgagttgctcgatacggcaatggaatcggtgctcgccacgccgtcgctgcggcacatcaccgtctttgactatcatcccggtgtcgacgtgcagcgcgaaagtctcgaatccgcacagcaccggatcgccgaggccggcctgccgatttcggtagacccgatacccctggcgatcgggcacgggcgcgccttgccggatgcgccgttgttcaccgcagaggagggtaccgacccgctggccctggtgatctacacctcgggaagcaccggaactcccaagggcgccacctatagcgaaaagatggtcgccaagccctggctgcgggccgacacgttgagctctaaggccgaaattcctttgatcaacctgaatttcatgccaatgagccatgtgatgggacgcggtagtctggtcactgccctggcctgcggcggcctggcttactttgccgcgtccagcgacatgtccacgctgttcgaagacatcacgcttacgcgccccaccgtggtgacactcgtgccccgtgtgtgcgacatgcttttccagcgctaccgcaacgaggttgaacgccgtaccgggcttgatccggcggccgacctggccacccttgatgccgatgtcaagaccgatatccgcgaaaacctgttcggcgggcgtgttctgacaatcgtgtgcggctctgccccactgtccgaggaactggccgccttcatcgaatcctgcctcgatgcccgtatcaccgatggctacggctccaccgaggcgggcgtcatcgtgcgcaacggccgcattcagcgcccgcccgtcatcgactacaagctggtcgacgtgcctgagctcggttacttctccaccgacaagccgcacccgcgcggcgagctgctcgtgaaagccgaatcggtgttcggcggctacttcaaacgccccgacgtcaccgccgacgtattcgatcccgacgggtactacaagaccggggacatcgtcgccgagctcgagcccgacaagatccagatcgtggaccggcgcaacaacgtgatcaagctgtcccagggtgagttcgtggcgatcgccaacctggaagccgagttcgccaatagtccactggtgcatcagatctgcgtctacggcagcagcgagcggtcgtatctgctagcggtggtcgtgccgaccgctgaggcatatgaacaaagcggtggagatgaggatctactcaaacgcctgatcgcggactctctcgcgcaggttgcccgcgaggcccaactgcagtcctacgaggtaccgcgcgacttcctgctggagaccgaaccgttcaccgctgccaacggcctactgaccggcatcgcgaagctggcccgaccgaagctccatgagaagtacggcgcccgcctggagcagctgtactccgatatcgccgccgcccaggcgcttgagctgcaagcactgcactctgccggacatgaggacaagcctgtcctggataccgtgcaacgcgcggtcacggcgttgttggggctgtcggcggccgaggtgagcccagacgcgcatttcatcgaccttggtggcgattcactatccgcccttgccttctcggacctgctgcgcgatatcttcactgtggaggttccggttggcgatatcgtcagcgccgccaacgatctgaccgctatcgcacgcatcgtggaaagacaccgggaagcagacggtcattcggtaactcccaccgccgaatccgtgcacggtgccgggcaccgcgagatccgggccgcggacctgacgctggacaagttcatcgacgcggacaccctgcgcgcggccccggcactgtccacattcaccggcaccccgcacacggtgctgctcaccggcgccaacggctacctggggcggttcctggccctggaatggcttgagcgcctggacaagacagacggcaagctgatcgccatcgtccgcggtaagaatgccgaggccgcctaccgccgcctggaggaagccttcgacaccggcgacacgcagctgttggcgcacttccggtcgctggccgacaagcacctcgaagtactggccggcgatatcggcgaccccaaccttggcctggatgccgacacctggcagcgcctggccgagaccgtcgacgtcatcgtgcaccccgccgccctggtcaaccacgtactgccctacagccagctgttcggacccaatgtcgttggcaccgccgaaatcatcaagctggcactcaccaccaagatcaagcccatcacctacctctccacagtggccgtggcaatctcggtggaccccaaggtattcgatgaagactccgacatccgcacgatcagcgcggtacgaccaatcaacgacggctacgccaacggatacggcaacgcgaaatgggctggcgaggtactgctgcgcgaagcccacgacctgtgcggactacccgtcgcggtcttccgctccgacatgatcttggcccacagccgctacaccggacagctcaacgtgcccgaccagttcacccgactaatcctcagcctcatcgccaccggagtcgcacccggctccttctaccaagcacacgccaccggcgaacgcccactcgcccactacgacggcctgcctgcggatttcacggcatcggccatcaccgccctcgggcccatcgaggagttccacacctacgattcggtgaacccgcatgccgatgggatctcgctggacaacttcgtcgactggctcatcgaagccggctaccccatcgcacgcatcgacaactacaccgaatggttcacccgcttcgacaccgccatccgaagcctccccgaaaaacagaaacaacactccctactaccactactacacgcgtacaggcatccacaacacccacacaacggcgcattcctgcccgcgatcaggttcagtgaaggcgtccaggcccatctgaacgccgacatcccgcacctcacgcgggaactcatcgcgaaatacgcggccgacctgaagcagctcgggttactctag

SEQ ID NO: 62 - protein, 1183 aa, Mycobacterium abscessus
MTIDATADNTKEARRQRLGDRIRRLFTDDEQFRAAKPDTAVDTAVAQPGLRLAQVVATIMNGYADRPALGHRVQELVADAAGRSTLRPLPEFETVTYGELWGMARALASTWYHDPAAPVRAGDFVAMLGFTSVDYTAVDLACIHLGAVAVPLQTSASASNWTAILAESEPAVLAVSAELLDTAMESVLATPSLRHITVFDYHPGVDVQRESLESAQHRIAEAGLPISVDPIPLAIGHGRALPDAPLFTAEEGTDPLALVIYTSGSTGTPKGATYSEKMVAKPWLRADTLSSKAEIPLINLNFMPMSHVMGRGSLVTALACGGLAYFAASSDMSTLFEDITLTRPTVVTLVPRVCDMLFQRYRNEVERRTGLDPAADLATLDADVKTDIRENLFGGRVLTIVCGSAPLSEELAAFIESCLDARITDGYGSTEAGVIVRNGRIQRPPVIDYKLVDVPELGYFSTDKPHPRGELLVKAESVFGGYFKRPDVTADVFDPDGYYKTGDIVAELEPDKIQIVDRRNNVIKLSQGEFVAIANLEAEFANSPLVHQICVYGSSERSYLLAVVVPTAEAYEQSGGDEDLLKRLIADSLAQVAREAQLQSYEVPRDFLLETEPFTAANGLLTGIAKLARPKLHEKYGARLEQLYSDIAAAQALELQALHSAGHEDKPVLDTVQRAVTALLGLSAAEVSPDAHFIDLGGDSLSALAFSDLLRDIFTVEVPVGDIVSAANDLTAIARIVERHREADGHSVTPTAESVHGAGHREIRAADLTLDKFIDADTLRAAPALSTFTGTPHTVLLTGANGYLGRFLALEWLERLDKTDGKLIAIVRGKNAEAAYRRLEEAFDTGDTQLLAHFRSLADKHLEVLAGDIGDPNLGLDADTWQRLAETVDVIVHPAALVNHVLPYSQLFGPNVVGTAEIIKLALTTKIKPITYLSTVAVAISVDPKVFDEDSDIRTISAVRPINDGYANGYGNAKWAGEVLLREAHDLCGLPVAVFRSDMILAHSRYTGQLNVPDQFTRLILSLIATGVAPGSFYQAHATGERPLAHYDGLPADFTASAITALGPIEEFHTYDSVNPHADGISLDNFVDWLIEAGYPIARIDNYTEWFTRFDTAIRSLPEKQKQHSLLPLLHAYRHPQHPHNGAFLPAIRFSEGVQAHLNADIPHLTRELIAKYAADLKQLGLL

SEQ ID NO: 63 - DNA, 3492 bp, Mycobacterium abscessus
atgacggctggtgcggcggctcgcgttgccaaactgttcgagtccgatccccaattccgggcagccatgccggatccagcggtgatggactcgctgctggcgcccggcctgcgtttatcccaggtactccacgcgttgctcagcggttacgcggagcgcccggtgatgggtttccggtcccgcgagtcggtggtcgacaccgccaccggccgcacggtcgaccggctgctccctgcctttgaaaccatcacctatgggcaactcctggaagacatctcggccatcctcgcggagtggcagcatggcgacattcccatgggcgccggcgacttcatcgccaccatcggcttctccagtcccgactacgtcaccctggatctggccaccctcatgaatggttcggtctcgatcccactgcagcacaacacatctgtggcgcagctgcggatgatgctggaggagaccagcccacgcctggtggcggcgagcgcggactgcctggatctcgcggtcgaggcagctgtcgggcttaccgatctgcgacgggttgtggtgttcgattaccgcgccgagaccgacgatcatcgcgaaaaactggccacggcaagagaacgcttgcacgcggccggtatggacgttgtagtcgaaccgctcgcagaggtgatcgggagaggacgagacctacccgaacccgtgctgtacacggccggggacgatcagcgcacggccctgatcatgtacacctccggtagcaccggcgcgcccaagggggcgatgttcaccgagtggacggtgacccgcttctggtcctcgggcgccgcccccaaccgggacaccccgatcatcaacgtgaacttcctgccgctcaaccaccttgcgggccgggtaggactgctgacggccttcattcccggcggcacatgctacttcgtccccgagagcgatctgtccaccctgttcgaggactggcagctggcacggcccacccatatgggtgtggttccccgtgtcgtcgacatgctcttccagcactaccaaacgcgagtggacgcactgatggccgggggaaccgacgtcgacaccgccgatcggctagccaaaaccgaactgcgcgaagatgtcctgggcgggcgtgtggtcgccggcatgctcgccaccgcgccgttgtcccccgagatgaaggctttcctggagtcctcattggactttcatctgcttgatctgtacggcctgaccgaggtcggcggcgtgttccgagacggcaagatttcccggccgccggtgctcgactacaagctcgtcgatgttcctgagctcgggtactacaccaccgacaagccccatccgcgtggcgaattgctggtcaagagtgccaccgcaacgcccggctactacaagcgtcccgacgtcaccgccgaggtgttcgacgccgatggctactaccgcacgggcgatgtcatggcggaggtcgcgccggaccaattggtgtacgtggacaggcgcaataacgtcatcaagctcgcccagggcgagttcgtcgcggtcgccaatttggaaacggtctatgtgggtgcgccgctggtgcgccagatcttcgtctacggcaacagcgaacgcgcatacctcctcgccgttgtggtgcccaccgaggaagccctgcgggcacacccggaccccgtcgaactgaagaattcgatccgggagtcactgcagcggaccgcccgctccaaccacctgcattcctacgagctgcccgccgacttcattatcgaaaccactccattcacgatcgagagtgggatgcttgcggctgtcggtaagccgatacgtcccaagatgatcgagcactacggcgaccggctcgagcagctctacgtcgacctcgccgaggcacgcgtccaggaactgcggcagctccgcgatacggcgcaacaacgcccggtcctcgataccgtcaccgaggccgcccaggccctcctcggcatgtctgcggacgccgtccgtcccgaccaccacttcatcgacctcggcggagattcgctgtccgcgttgacattctccaatcttcttcgagacctcttcgacgtcgaggttccggtcggtgtgatcaccggcccggcggccgatctgcgcaagctcgccgcttacatccagcacgaacgggagcacagcaccgcgaccgctgccagcgtgcacgggctcgacaccaccgtcatcagcgccaccgaactgacactcgacaagttcatcgacgccgagacactccacaacgcttcgcaactcgacgtgccggcgggcgcggtagctaccgttctgctcaccggcgccaacggatatctcggaagattcctctgcctggagtggctgcaacggctgtcccagacaggtggacaactgatctgcctggtccgcggcgacaacgccgatcaagccctcgcgcgcctcgttgccgcctacggcgacaccgatcgcacactgctcgaggagttccacaccctggctcgacggcacctgcgcgtgatcgccgccgatatcgctcagccgcgcttcggcgtggatgacgccacctgggagcagctggcccgcgatgtcgacaagatcgtgcatccggccgcgctggtcaaccacgtgctgccctacaaccagctgttcggccccaatgtgtttggcacggcggaggttatccggctggccctgaccacccggatcaagccggtgacctatctgtcgacgatggccgtggccatgaccgtgcccgatttcgacgaggacggggacatccgcacggtgagtcccacccggcatatcgaccccggctacgccaacgggtacgccaacagcaaatgggccggcgaggtgctgctgcgggaggcacacgacatatgcggcctgccggtcagcgtgttccggtccgacatgatcctgacgcaccgccgttacagcggacaactcaacgtcaccgacgccttcacccgcatgctgctgagcctggtgctcaccggcatcgcgccgcgaagcttttaccaaggcgatggcagcggtgcccgcccacgcgctcactacgaggggctgccggtcgatttcgtcaccgaagccattaccagcctcggcctgtcctcgtccgagggatttcgctcgtacgacgtcatgaatcctcacgatgacggcatttctgtggacacctttgtcgactggctcatggaagatgggcattccatcgacatcatcgacaactacgacgaatggctgtcccgtttcgagacggcattgcgaggtctgcccgacgagcagcggcgcgcctcagtacttccgctcctcgatgcgtatcggataccgggcaacccgcgccgtgctgccgccacgcccaatcatgtattccggaaagccgtacaggagaacaacatcggaggtgacggcgccgatattccgcaaatcgatcgtgcgctgatcgccaaatacatcgccgatctacgagcacacaggctgctgtga

SEQ ID NO: 64 - protein, 1163 aa, Mycobacterium abscessus
MTAGAAARVAKLFESDPQFRAAMPDPAVMDSLLAPGLRLSQVLHALLSGYAERPVMGFRSRESVVDTATGRTVDRLLPAFETITYGQLLEDISAILAEWQHGDIPMGAGDFIATIGFSSPDYVTLDLATLMNGSVSIPLQHNTSVAQLRMMLEETSPRLVAASADCLDLAVEAAVGLTDLRRVVVFDYRAETDDHREKLATARERLHAAGMDVVVEPLAEVIGRGRDLPEPVLYTAGDDQRTALIMYTSGSTGAPKGAMFTEWTVTRFWSSGAAPNRDTPIINVNFLPLNHLAGRVGLLTAFIPGGTCYFVPESDLSTLFEDWQLARPTHMGVVPRVVDMLFQHYQTRVDALMAGGTDVDTADRLAKTELREDVLGGRVVAGMLATAPLSPEMKAFLESSLDFHLLDLYGLTEVGGVFRDGKISRPPVLDYKLVDVPELGYYTTDKPHPRGELLVKSATATPGYYKRPDVTAEVFDADGYYRTGDVMAEVAPDQLVYVDRRNNVIKLAQGEFVAVANLETVYVGAPLVRQIFVYGNSERAYLLAVVVPTEEALRAHPDPVELKNSIRESLQRTARSNHLHSYELPADFIIETTPFTIESGMLAAVGKPIRPKMIEHYGDRLEQLYVDLAEARVQELRQLRDTAQQRPVLDTVTEAAQALLGMSADAVRPDHHFIDLGGDSLSALTFSNLLRDLFDVEVPVGVITGPAADLRKLAAYIQHEREHSTATAASVHGLDTTVISATELTLDKFIDAETLHNASQLDVPAGAVATVLLTGANGYLGRFLCLEWLQRLSQTGGQLICLVRGDNADQALARLVAAYGDTDRTLLEEFHTLARRHLRVIAADIAQPRFGVDDATWEQLARDVDKIVHPAALVNHVLPYNQLFGPNVFGTAEVIRLALTTRIKPVTYLSTMAVAMTVPDFDEDGDIRTVSPTRHIDPGYANGYANSKWAGEVLLREAHDICGLPVSVFRSDMILTHRRYSGQLNVTDAFTRMLLSLVLTGIAPRSFYQGDGSGARPRAHYEGLPVDFVTEAITSLGLSSSEGFRSYDVMNPHDDGISVDTFVDWLMEDGHSIDIIDNYDEWLSRFETALRGLPDEQRRASVLPLLDAYRIPGNPRRAAATPNHVFRKAVQENNIGGDGADIPQIDRALIAKYIADLRAHRLL

SEQ ID NO: 65 - DNA, 3537 bp, Mycobacterium abscessus
atgactgaaacgatctccacagcggctgtccccactacggatctcgaagagcaggtgaagcgacgcatcgagcaggtcgtgtccaacgatccgcagctggcggcgcttctcccggaagattcggtcaccgaggcggtcaacgagcccgatctaccgctggtcgaggtgatcaggcgactgctggagggctacggtgaccgcccggcactcggccagcgcgccttcgagttcgtcaccggggacgacggtgcgaccgtgatcgcgctgaagcccgaatacaccaccgtctcctaccgcgagttgtgggaacgtgccgaggctatcgctgccgcgtggcacgagcagggcatccgtgacggcgacttcgtcgctcagttgggtttcaccagcacggacttcgcgtcgctcgacgtcgcgggattgcgtctgggcaccgtctcggtgcccctgcagacgggcgcgtcgctgcagcagcgcaacgcgattctcgaagagacccggcccgcagtctttgccgcgagtatcgaataccttgatgccgccgtcgattcggtgcttgcgaccccctcggtgcgactcctctcggttttcgactatcacgcggaggtcgacagccagcgcgaagcgctggaggctgtgcgggcccggcttgagagtgccggccggacgatcgtcgtcgaggccctggcggaggctctcgcgcgggggcgggacctgcccgccgcgccgctgcccagtgcagatcccgatgccttgcgtctgctcatctacacctccggcagcaccggtacccccaagggcgccatgtatccgcaatggctggtcgccaacttgtggcagaagaagtggctcaccgacgatgtgattccgtccataggcgtgaacttcatgcccatgagccacctggcgggtcgcctcactctcatgggcaccctttccggtggcggaaccgcctactacatcgcttcgagcgatctttcgactttcttcgaggacatcgcgctcatccgcccctccgaagtgctcttcgtgccgcgtgtggtggagatggtgttccagcgttttcaggcagaattggaccggtcccttgccccgggtgagagcaactccgagatcgcggagcgaatcaaggtccgcatccgggaacaggacttcggcgggcgtgtgctcagtgctggctccgggtcggccccgttgtctcctgagatgacggagttcatggagtcgctgctgcaggtgccgttgcgcgacgggtatgggtccaccgaggccggtggtgtgtggcgtgacggagtcctgcagcgtccgcccgtcaccgactacaagctggttgacgttccggaactcggatacttcaccacagattcgccgcatccccgtggcgagctgcggttgaagtcggagacgatgttccccggctactacaagcgcccggagaccactgccgatgtcttcgatgacgaggggtactacaagaccggtgacgtggtcgccgagctcgggccggatcacctcaagtacctcgaccgcgtcaagaacgtcctcaagctcgcgcagggagagtttgtcgcggtgtcaaagctggaggccgcttacaccggcagcccgctggtccggcagatctttgtgtacgggaacagtgaacgctcgttcctgctggctgtcgtggtcccgacacccgaagtccttgagcggtacgcagattcgccagatgcgctcaagcccttgatccaggattcgctgcagcaggtcgccaaggacgcggagctgcaatcctatgagataccgcgcgacttcatcgttgagacggtgccgttcaccgtcgagtccggattgctatcggacgcgcgaaagctgctgcgccccaagctgaaggatcactacggagagaggctggaggcgctgtacgccgaactggcggaaagccagaatgagcggctgcgccagttggccagggaggcagccacgcgcccggtcctggagacggtgaccgatgcggccgccgcgctgctgggcgcatcgtcctcggatctggctcctgatgtgcgattcatcgacctcggtggcgactcactgtcggcgctgtcgtactccgagctgctgcgcgacatctttgaggtggacgttccggtgggcgtcatcaacagcgtcgccaacgaccttgccgcgatcgcccggcacatcgaggcgcagcggaccggcgccgctacgcagccgacctttgcgtcggtccacggcaaggacgcgacggtcatcaccgccggtgaactcaccctcgacaagttcttggacgagtcactgttgaaagcggccaaggacgttcagccggcaacggccgatgtcaagaccgttctagtgaccggcggcaacggctggttgggtcgttggctggtgctcgattggctggagcggttggcacccaatggtggcaaggtctacgccctcattcgtggcgccgatgccgaagcagcccgggcacggttggacgccgtgtacgaatcgggtgatcccaagctgtccgcgcattatcgtcagctggcgcaacagagtctggaagttatcgccggcgatttcggcgaccaggatctcggtctatcccaggaagtttggcagaagctggccaaggacgtggacctgatcgtgcactccggtgccttggtgaaccacgtgctgccgtacagccagttgttcggtccgaatgtggcgggtaccgccgagatcatcaagctggcaatttcggagcggctcaagccggtcacctacctgtcgacggtgggcatcgccgaccagattccggtgacggagttcgaggaagactccgatgttcgtgtgatgtcggccgagcgccagatcaatgacggctacgcgaacggatacggcaactcaaaatgggccggcgaggtgctgttgcgggaggctcatgacctagcggggctgccggtgcgtgtgttccgctccgacatgatcctggcgcacagtgactaccacggacagctcaacgtcaccgacgtgttcacccggagcatccagagtctgctgctcaccggtgttgcaccggccagcttctatgaattggatgccgacggcaatcggcagcgcgctcactatgacggtgtgcccggcgatttcaccgccgcatcgatcaccgccatcggcggtgtgaacgtggtagacggttaccgcagcttcgacgtgttcaacccgcaccatgacggtgtctcgatggataccttcgtcgactggctgatcgacgcaggctacaagatcgcgcggatcgacgattacgaccagtggctcgcccggttcgagctggccctcaagggattgcccgagcagcagcggcaacagtcggtgttgccacttctcaagatgtacgagaagccgcaaccggcgatcgacggaagtgcacttccgaccgcagaattcagtcgcgccgtgcacgaggcgaaggtcggagacagcggtgagataccgcacgtcaccaaggagctgatcctcaagtacgccagcgatattcagctgttgggcctggtgtag

SEQ ID NO: 66 - protein, 1178 aa, Mycobacterium abscessus
MTETISTAAVPTTDLEEQVKRRIEQVVSNDPQLAALLPEDSVTEAVNEPDLPLVEVIRRLLEGYGDRPALGQRAFEFVTGDDGATVIALKPEYTTVSYRELWERAEAIAAAWHEQGIRDGDFVAQLGFTSTDFASLDVAGLRLGTVSVPLQTGASLQQRNAILEETRPAVFAASIEYLDAAVDSVLATPSVRLLSVFDYHAEVDSQREALEAVRARLESAGRTIVVEALAEALARGRDLPAAPLPSADPDALRLLIYTSGSTGTPKGAMYPQWLVANLWQKKWLTDDVIPSIGVNFMPMSHLAGRLTLMGTLSGGGTAYYIASSDLSTFFEDIALIRPSEVLFVPRVVEMVFQRFQAELDRSLAPGESNSEIAERIKVRIREQDFGGRVLSAGSGSAPLSPEMTEFMESLLQVPLRDGYGSTEAGGVWRDGVLQRPPVTDYKLVDVPELGYFTTDSPHPRGELRLKSETMFPGYYKRPETTADVFDDEGYYKTGDVVAELGPDHLKYLDRVKNVLKLAQGEFVAVSKLEAAYTGSPLVRQIFVYGNSERSFLLAVVVPTPEVLERYADSPDALKPLIQDSLQQVAKDAELQSYEIPRDFIVETVPFTVESGLLSDARKLLRPKLKDHYGERLEALYAELAESQNERLRQLAREAATRPVLETVTDAAAALLGASSSDLAPDVRFIDLGGDSLSALSYSELLRDIFEVDVPVGVINSVANDLAAIARHIEAQRTGAATQPTFASVHGKDATVITAGELTLDKFLDESLLKAAKDVQPATADVKTVLVTGGNGWLGRWLVLDWLERLAPNGGKVYALIRGADAEAARARLDAVYESGDPKLSAHYRQLAQQSLEVIAGDFGDQDLGLSQEVWQKLAKDVDLIVHSGALVNHVLPYSQLFGPNVAGTAEIIKLAISERLKPVTYLSTVGIADQIPVTEFEEDSDVRVMSAERQINDGYANGYGNSKWAGEVLLREAHDLAGLPVRVFRSDMILAHSDYHGQLNVTDVFTRSIQSLLLTGVAPASFYELDADGNRQRAHYDGVPGDFTAASITAIGGVNVVDGYRSFDVFNPHHDGVSMDTFVDWLIDAGYKIARIDDYDQWLARFELALKGLPEQQRQQSVLPLLKMYEKPQPAIDGSALPTAEFSRAVHEAKVGDSGEIPHVTKELILKYASDIQLLGLV

SEQ ID NO: 67 - DNA, 3447 bp, Streptomyces griseus
atggccgaaccgctggacgccgccaccgcgtcggcgcacgatccgggccaggggctcgccgaggccctggccgccgtcgaaccgggccgggcgctcgccgaggtcatggcgtccgtcctggagggccacggggaccggcccgccctcggcgaacgggcccgggagccggagaccgggcgtctcctcccgcacttcgacaccatcagctaccgcgaactgtggtcccgcgtccgtgcgctggccggccggtggcaccacgacccggaataccccctgggccccggcgaccggatctgcaccctcggcttcaccagcaccgactacgcgacgctcgacctggcgtgcatccacctgggggccgtgcccgtccccctcccgtccaacgccccgctgccccgactggcgccggtcgtcgaggagtccgggccgacggtactggccgcgagcgtcgaccggctcgacaccgccatcgacgtcgtcctcgcgtcgagcacgatccgccgcctcctcgtcttcgacgacggcccgggggccacccgcccgggcggggcactggcggccgcccgccaacgcctgtccggcagcccggtcaccgtcgacaccctggccggactcatcgaccggggcagggacctgccgcccccgcccctgtacatcccggacccgggggaggacccgctcgccctgctcatctacacctccggcagcaccggcgcgcccaagggcgccatgtacacccaacggctcctgggcaccgcgtggtacgggttcagctacggggcggccgacacccccgcgatcagcgtcctctacctgccgcagagccacctcgcgggccgctacgcggtgatgggatcgctcgtgaaggggggcaccggctacttcaccgctgccgacgacctgtccaccctgttcgaggacatcgccctggtccgccccacggagctgaccatggtcccgcgcctgtgcgacatgctcctccagcactaccggagcgaacgggaccgccgggccgacgaaccgggcgacatcgaggcggcggtcacgaaggcggtgcgggaggacttcctgggcgggcgcgtcgccaaggcgttcgtcggcaccgcgccgctctccgccgaactcacggcgttcgtcgagtccgtcctcggcttccacctctacaccggctacggctccaccgaagccggcggagtgctgctggacacggtggtgcagcgccctccggtcaccgactacaaactggtcgacgtccccgaactgggctactacgcgaccgacctgccccatccgcgcggcgaactgctgctgaagtcccacacgctcatccccggctactaccggcgccccgacctcaccgccgcgatcttcgacgcggacggctactaccgcaccggtgacgtcttcgccgagaccggacccgaccggctggtctacgtcgaccgcacgaaggacaccctgaagctgtcccagggcgagttcgtggccgtgtcccgcctggagaccgtcctcctcgacagccctctcgtccagcacctctacctgtacggcaacagcgagcgcgcctacctcctcgcggtggtggtgcccaccccggacgcgctggccgggtgcggcggggacaccgaggcgctcaggccgctgctcatggaatccctccgcagcgtcgccaggagggccgggctcaacgcgtacgagatcccgcgcggcatcctcgtcgagcccgagcccttcagcccggagaacggcctcttcaccgagagccacaaactgctgcgcccccgcctcaaggagcgctacgggcccgctctggagctgctgtacgaccgactggccgacgggcaggaccgccggctgcgcgagctgcggcgcaccggtgcggaccggccggtgcaggagacggtcctccgggccgcccaggccctgctgggatccccgggctccgacctccggcccggcgcgcacttcaccgacctcggcggggactccctctccgccgtctcgttctccgagctgatgaaggagatcttccacgtcgacgtcccggtcggtgcgatcatcggcccggccgccgacctggcggaggtggcgcggtacatcacggcggcccgtcggccggccggggcaccgcggcccacgcccgcctccgtgcacggggagcaccgcaccgaagtccgcgccggggacctcgccccggagaagttcctcgacgcgcccacgctcgccgccgctccggcgctgccccgccccgacggcgacgtccggacggtcctgctgaccggcgccaccggctacctcggccggttcctctgcctggagtggctggagcggctggcgccctcgggcggacggctggtctgcctcgtccgcggcagcgacgcgaccgtcgcggcgaggcggctggaggcagccttcgacagcggcgacaccgccctgctccggcgctaccggaaggcggccgggaagaccctggacgtggtcgcgggggacatcggcgaaccactgctgggcctggcggaggagacctggcgggaactggccggcgccgtggacctgatcgtgcacccggccgcgctggtcaaccacctgctgccgtacggcgaactgttcggccccaacgtcgtcggcaccgccgaagcgatccggctggcgctcaccacccggctgaagcccgtcaaccacgtctcgaccgtcgcggtctgcctcggcacccccgccgagacggccgacgagaacgccgacatccgggccgccgtcccggtacggaccaccggccaggggtacgccgacggatacgcgaccagcaaatgggccggcgaggtcctcctgcgtgaggcgcacgagcgctatggcctccccgtcgccgtcttccggtccgacatggtcctggcgcaccgcacctacaccggacaggtcaacgtccccgacgtcctcacccggctgctgctcagcctggtcgccaccggcatcgcccccggctcgttctaccgcacggacacccgtgcccactacgacggcctgccggtcgacttcaccgcggaggccgtcgtcgcgctgggcgcaccgatcaccgagggccaccggaccttcaacgtcctcaacccgcacgacgacggcgtttccctggacaccttcgtcgactggctcatcgaggccggccacccgatccggcggatcgacgaccacggtgcctggctcacccgcttcaccgcggcgctccgcgccctgccggagaagcagcggcagcactccctgctcccgctgatcggcgcctgggcggaacccggcgaaggagcccccgggccgctgctccccgcccggcgcttccacgccgccgtccgggcggcgggggtcggccccgagcgggacattccccgggtgtcgccggacctcatccgcaagtacgtcaccgacctgcgcgcactcgggctcctcgccggcccctga

SEQ ID NO: 68 - protein, 1148 aa, Streptomyces griseus
MAEPLDAATASAHDPGQGLAEALAAVEPGRALAEVMASVLEGHGDRPALGERAREPETGRLLPHFDTISYRELWSRVRALAGRWHHDPEYPLGPGDRICTLGFTSTDYATLDLACIHLGAVPVPLPSNAPLPRLAPVVEESGPTVLAASVDRLDTAIDVVLASSTIRRLLVFDDGPGATRPGGALAAARQRLSGSPVTVDTLAGLIDRGRDLPPPPLYIPDPGEDPLALLIYTSGSTGAPKGAMYTQRLLGTAWYGFSYGAADTPAISVLYLPQSHLAGRYAVMGSLVKGGTGYFTAADDLSTLFEDIALVRPTELTMVPRLCDMLLQHYRSERDRRADEPGDIEAAVTKAVREDFLGGRVAKAFVGTAPLSAELTAFVESVLGFHLYTGYGSTEAGGVLLDTVVQRPPVTDYKLVDVPELGYYATDLPHPRGELLLKSHTLIPGYYRRPDLTAAIFDADGYYRTGDVFAETGPDRLVYVDRTKDTLKLSQGEFVAVSRLETVLLDSPLVQHLYLYGNSERAYLLAVVVPTPDALAGCGGDTEALRPLLMESLRSVARRAGLNAYEIPRGILVEPEPFSPENGLFTESHKLLRPRLKERYGPALELLYDRLADGQDRRLRELRRTGADRPVQETVLRAAQALLGSPGSDLRPGAHFTDLGGDSLSAVSFSELMKEIFHVDVPVGAIIGPAADLAEVARYITAARRPAGAPRPTPASVHGEHRTEVRAGDLAPEKFLDAPTLAAAPALPRPDGDVRTVLLTGATGYLGRFLCLEWLERLAPSGGRLVCLVRGSDATVAARRLEAAFDSGDTALLRRYRKAAGKTLDVVAGDIGEPLLGLAEETWRELAGAVDLIVHPAALVNHLLPYGELFGPNVVGTAEAIRLALTTRLKPVNHVSTVAVCLGTPAETADENADIRAAVPVRTTGQGYADGYATSKWAGEVLLREAHERYGLPVAVFRSDMVLAHRTYTGQVNVPDVLTRLLLSLVATGIAPGSFYRTDTRAHYDGLPVDFTAEAVVALGAPITEGHRTFNVLNPHDDGVSLDTFVDWLIEAGHPIRRIDDHGAWLTRFTAALRALPEKQRQHSLLPLIGAWAEPGEGAPGPLLPARRFHAAVRAAGVGPERDIPRVSPDLIRKYVTDLRALGLLAGP

SEQ ID NO: 69 - DNA, 3543 bp, Mycobacterium marinum
ttgtcaattacctgtgtggatacccgtgcacagcggagcgcccgtcgcatcgagcagctttactccaccgatgcgcaattcgccgccgcccggcccagtacggcggtcggtatcgcaatcagcaagtccgggttgggattaccacagatcattcaaacggtgatggacggatacccgcaacgtccggcacttgggcagcgggcgacgcgcgttgttaccgatccgaataccgggcgtagctcggcgcagctgttggcggagttcgagaccatcacctaccgggagttgtggaaccgcaccaatgcattgaccaacgcattcgccgccgaggcacttgcggatcgcggtcagcgggtctgtgtgctgggattcgcgagcatcgactacgccaccatcgacttggcgctgatgttgctcggcgcggtatcggttccgttgccgacgaatgcggctcgcgcccagctgtgccatatcgtctccgagacccagcccagcctgatcgcctcgagtaccgaaaacctgcccgatgcaatctctttggtgctgtcgcaccgcgcaccacaccgggtggtggtgttcgactaccgccccgaactcgacgcacaccgcgaagccctcgaagccgctcgcgcgcgcctggccgccatcccggtgaccgtcgaaacgctcaccgccatcatcgcgcgcggtcgaacggtgcggccggccgaggccgattgcggcgcccagtccgctgatgcaccggcgcttttgatctatacctccggaagcaccggggcacccaagggcgtcgtctacacccgcaaccgggtggcggacttctggcgcacctcgaaagccgaggtcgaagcgaccgaacaacgaaccgctccttcgatcaccctcaacttcatgccgatgagccacgcgaacggccgccaggtgctctacgggacgctgtccaacggcggcaccgcgtatttcacggcccgcagcgacctctcgacgctcttcgatgatctcgcgttggtccggcccaccgaattgggctttccaccgcgcatttgggacatgctgttggagaggtttgggcgcgaagtcgaccgtcggctccgggacggcacagccgagggcgccgacccgggcgcgctgaaggctcgcgtggcggccgacctacgccaggtgctgctcggcggacggtatgcgctggcgatgatgggctccgcgccaatctccgagcagatgaaagcatccgtcgaatccctgctcgatctggacgtcatggagggctatggctccacggaagccggaacggtcatcatcaacaacgaggttcagcgtccccaggtgatcgactacaagctggtcgacgttgcggaactgggctatttccttaccgaccggccatatccgcggggcgaactgctggtcaaaacgcggacactgttttccggctactaccgggaccccgaagacggcgcccaggtcttcgacccggacggcttctaccggaccggcgacatcatggcccaagtcggccccgatcggctcgcctacctcgaccggcgcaacaacgtgctgaagctgtcgcagggggagttcgtcgcggtctcgcgactagaagcaatatttgccaatagcccgttggtccggcagatcttcgtctatgccaacggtgctcgcgcctacccactggcggtagtcgtgcccacccaggacgcacagtcgcgccacggtcgcgccgaactcaaggccgaactccatacatcgctgcaccgcgttgccatgtcggccggtctggcaccctacgagatcccacgcgacttcattgtcgagacaacccccttcacgccgcagaacggcctgctcaccgcaatccacaagctggcccggccgcacctcacgcagcgctatggcgcacgtctggagctgctgtacaccgagctggccgacagccagacccgccggctgcaccgattgcgccaaaccggtgggcggctgccggcgctcgagaccatcaggcgtgccgccggggcactgttgggcacggagaccaccgagccgcggcccgaggcccacttcaaagatctgggcggggattcggtatcggcggtgacgttctccaacctgctacacgacatctacggtttcgatgttccggtcggtgtgatcctcggcccggcaaccgatttgcgggcgctggccagccacgtcgagagccggcgcggtgccggatggtcggggcccagcttcgcgtcggtgcacgtgccccgggcgacctcggtacacgccggcgacctgaaactggccaagttcctggacaccaagacactcgcagctgccacgagcctgcccgctgccgatgcccgggcacggacggtgctactcaccggcgcaaccggattcctgggacgctacctggtgctggaatggctgcgccggttgcgggccgtcggcggcaagctgatctgtctggtgcgcgccgcgtccgacgaacaagcccgggttcggctggatacggccttcgatagcggcgatccgcagctgcccgagcactttcggcagctcgctgtcgaccgcctggaggtcctcgccggcgataagagcgaaccaggtctcggtctggacggcccaacctggcagcgactggccgacacggtcgacctgatcgtcgaccccgccacgctggtcaaccacgtgctgtcgtaccggcagctgttcgctcccaacgtggcgggcaccgccgagttgctccgcctcgcactcaccaccaaacgcaagccctatgcctacgtctcgaccgtcagcgtggccaaccagatcgaaccgtccgcattcaccgaagacgccgacatccgggagatcagccgcacccgaaccatcgatgacagctttgccaacggctacaccaccagcaagtgggccagcgaggtgctgttgcgtgaggctcacgatctgtgcggactgccggtcacggtctttcgttgcgacatgatcctggcggacaccagctacgccggccagctcaacctcgccgataccttcacccggctgatgctcagtgtggcggccaccgggatcgcgcccgcctcgttctaccggctgggccccgacggcaaacgccagcccgcccacttcgacggattgcccgtcgaattcatcgccgaggcggtggccaccctgggggcgcggcgccacgacgggttccaggtccaccatgtggcgaatccgcaccacgacggcgttgggttggacgagtacgtcgactggctagtcgatgccggttgccccatccggcgcattcccgactatgacgagtggctgagtcgattcgagacggcgctgcacgcgctgccggatcgcaagcgtcgtcattcactgcttccgctgctgcagaactatcgagaacccgccgagccgatccggggcggcatcgcgcccgcaccacggtttcgcggtgcggtacggcaggcgaaaatcggccgcgacaacgacattccccatgtcggcccggcgatcatcgccaagtacgccagcgacctgcagcttctcggcctggcttga

SEQ ID NO: 70 - protein, 1180 aa, Mycobacterium marinum
MSITCVDTRAQRSARRIEQLYSTDAQFAAARPSTAVGIAISKSGLGLPQIIQTVMDGYPQRPALGQRATRVVTDPNTGRSSAQLLAEFETITYRELWNRTNALTNAFAAEALADRGQRVCVLGFASIDYATIDLALMLLGAVSVPLPTNAARAQLCHIVSETQPSLIASSTENLPDAISLVLSHRAPHRVVVFDYRPELDAHREALEAARARLAAIPVTVETLTAIIARGRTVRPAEADCGAQSADAPALLIYTSGSTGAPKGVVYTRNRVADFWRTSKAEVEATEQRTAPSITLNFMPMSHANGRQVLYGTLSNGGTAYFTARSDLSTLFDDLALVRPTELGFPPRIWDMLLERFGREVDRRLRDGTAEGADPGALKARVAADLRQVLLGGRYALAMMGSAPISEQMKASVESLLDLDVMEGYGSTEAGTVIINNEVQRPQVIDYKLVDVAELGYFLTDRPYPRGELLVKTRTLFSGYYRDPEDGAQVFDPDGFYRTGDIMAQVGPDRLAYLDRRNNVLKLSQGEFVAVSRLEAIFANSPLVRQIFVYANGARAYPLAVVVPTQDAQSRHGRAELKAELHTSLHRVAMSAGLAPYEIPRDFIVETTPFTPQNGLLTAIHKLARPHLTQRYGARLELLYTELADSQTRRLHRLRQTGGRLPALETIRRAAGALLGTETTEPRPEAHFKDLGGDSVSAVTFSNLLHDIYGFDVPVGVILGPATDLRALASHVESRRGAGWSGPSFASVHVPRATSVHAGDLKLAKFLDTKTLAAATSLPAADARARTVLLTGATGFLGRYLVLEWLRRLRAVGGKLICLVRAASDEQARVRLDTAFDSGDPQLPEHFRQLAVDRLEVLAGDKSEPGLGLDGPTWQRLADTVDLIVDPATLVNHVLSYRQLFAPNVAGTAELLRLALTTKRKPYAYVSTVSVANQIEPSAFTEDADIREISRTRTIDDSFANGYTTSKWASEVLLREAHDLCGLPVTVFRCDMILADTSYAGQLNLADTFTRLMLSVAATGIAPASFYRLGPDGKRQPAHFDGLPVEFIAEAVATLGARRHDGFQVHHVANPHHDGVGLDEYVDWLVDAGCPIRRIPDYDEWLSRFETALHALPDRKRRHSLLPLLQNYREPAEPIRGGIAPAPRFRGAVRQAKIGRDNDIPHVGPAIIAKYASDLQLLGLA

SEQ ID NO: 71 - DNA, 3525 bp, Mycobacterium marinum
atgtcgccaatcacgcgtgaagagcggctcgagcgccgcatccaggacctctacgccaacgacccgcagttcgccgccgccaaacccgccacggcgatcaccgcagcaatcgagcggccgggtctaccgctaccccagatcatcgagaccgtcatgaccggatacgccgatcggccggctctcgctcagcgctcggtcgaattcgtgaccgacgccggcaccggccacaccacgctgcgactgctcccccacttcgaaaccatcagctacggcgagctttgggaccgcatcagcgcactggccgacgtgctcagcaccgaacagacggtgaaaccgggcgaccgggtctgcttgttgggcttcaacagcgtcgactacgccacgatcgacatgactttggcgcggctgggcgcggtggccgtaccactgcagaccagcgcggcgataacccagctgcagccgatcgtcgccgagacccagcccaccatgatcgcggccagcgtcgacgcactcgctgacgccaccgaattggctctgtccggtcagaccgctacccgagtcctggtgttcgaccaccaccggcaggttgacgcacaccgcgcagcggtcgaatccgcccgggagcgcctggccggctcggcggtcgtcgaaaccctggccgaggccatcgcgcgcggcgacgtgccccgcggtgcgtccgccggctcggcgcccggcaccgatgtgtccgacgactcgctcgcgctactgatctacacctcgggcagcacgggtgcgcccaagggcgcgatgtacccccgacgcaacgttgcgaccttctggcgcaagcgcacctggttcgaaggcggctacgagccgtcgatcacgctgaacttcatgccaatgagccacgtcatgggccgccaaatcctgtacggcacgctgtgcaatggcggcaccgcctacttcgtggcgaaaagcgatctctccaccttgttcgaagacctggcgctggtgcggcccaccgagctgaccttcgtgccgcgcgtgtgggacatggtgttcgacgagtttcagagtgaggtcgaccgccgcctggtcgacggcgccgaccgggtcgcgctcgaagcccaggtcaaggccgagatacgcaacgacgtgctcggtggacggtataccagcgcactgaccggctccgcccctatctccgacgagatgaaggcgtgggtcgaggagctgctcgacatgcatctggtcgagggctacggctccaccgaggccgggatgatcctgatcgacggagccattcggcgcccggcggtactcgactacaagctggtcgatgttcccgacctgggttacttcctgaccgaccggccacatccgcggggcgagttgctggtcaagaccgatagtttgttcccgggctactaccagcgagccgaagtcaccgccgacgtgttcgatgctgacggcttctaccggaccggcgacatcatggccgaggtcggccccgaacagttcgtgtacctcgaccgccgcaacaacgtgttgaagctgtcgcagggcgagttcgtcaccgtctccaaactcgaagcggtgtttggcgacagcccactggtacggcagatctacatctacggcaacagcgcccgtgcctacctgttggcggtgatcgtccccacccaggaggcgctggacgccgtgcctgtcgaggagctcaaggcgcggctgggcgactcgctgcaagaggtcgcaaaggccgccggcctgcagtcctacgagatcccgcgcgacttcatcatcgaaacaacaccatggacgctggagaacggcctgctcaccggcatccgcaagttggccaggccgcagctgaaaaagcattacggcgagcttctcgagcagatctacacggacctggcacacggccaggccgacgaactgcgctcgctgcgccaaagcggtgccgatgcgccggtgctggtgacggtgtgccgtgcggcggccgcgctgttgggcggcagcgcctctgacgtccagcccgatgcgcacttcaccgatttgggcggcgactcgctgtcggcgctgtcgttcaccaacctgctgcacgagatcttcgacatcgaagtgccggtgggcgtcatcgtcagccccgccaacgacttgcaggccctggccgactacgtcgaggcggctcgcaaacccggctcgtcacggccgaccttcgcctcggtccacggcgcctcgaatgggcaggtcaccgaggtgcatgccggtgacctgtccctggacaaattcatcgatgccgcaaccctggccgaagctccccggctgcccgccgcaaacacccaagtgcgcaccgtgctgctgaccggcgccaccggcttcctcgggcgctacctggccctggaatggctggagcggatggacctggtcgacggcaaactgatctgcctggtccgggccaagtccgacaccgaagcacgggcgcggctggacaagacgttcgacagcggcgaccccgaactgctggcccactaccgcgcactggccggcgaccacctcgaggtgctcgccggtgacaagggcgaagccgacctcggactggaccggcagacctggcaacgcctggccgacacggtcgacctgatcgtcgaccccgcggccctggtcaaccacgtactgccatacagccagctgttcgggcccaacgcgctgggcaccgccgagctgctgcggctggcgctcacctccaagatcaagccctacagctacacctcgacaatcggtgtcgccgaccagatcccgccgtcggcgttcaccgaggacgccgacatccgggtcatcagcgccacccgcgcggtcgacgacagctacgccaatggctactcgaacagcaagtgggccggcgaggtgctgttgcgcgaggcgcatgacctgtgtggcctgccggttgcggtgttccgctgcgacatgatcctggccgacaccacatgggcgggacagctcaatgtgccggacatgttcacccggatgatcctgagcctggcggccaccggtatcgcgccgggttcgttctatgagcttgcggccgacggcgcccggcaacgcgcccactatgacggtctgcccgtcgagttcatcgccgaggcgatttcgactttgggtgcgcagagccaggatggtttccacacgtatcacgtgatgaacccctacgacgacggcatcggactcgacgagttcgtcgactggctcaacgagtccggttgccccatccagcgcatcgctgactatggcgactggctgcagcgcttcgaaaccgcactgcgcgcactgcccgatcggcagcggcacagctcactgctgccgctgttgcacaactatcggcagccggagcggcccgtccgcgggtcgatcgcccctaccgatcgcttccgggcagcggtgcaagaggccaagatcggccccgacaaagacattccgcacgtcggcgcgccgatcatcgtgaagtacgtcagcgacctgcgcctactcggcctgctctga

SEQ ID NO: 72 - protein, 1174 aa, Mycobacterium marinum
MSPITREERLERRIQDLYANDPQFAAAKPATAITAAIERPGLPLPQIIETVMTGYADRPALAQRSVEFVTDAGTGHTTLRLLPHFETISYGELWDRISALADVLSTEQTVKPGDRVCLLGFNSVDYATIDMTLARLGAVAVPLQTSAAITQLQPIVAETQPTMIAASVDALADATELALSGQTATRVLVFDHHRQVDAHRAAVESARERLAGSAVVETLAEAIARGDVPRGASAGSAPGTDVSDDSLALLIYTSGSTGAPKGAMYPRRNVATFWRKRTWFEGGYEPSITLNFMPMSHVMGRQILYGTLCNGGTAYFVAKSDLSTLFEDLALVRPTELTFVPRVWDMVFDEFQSEVDRRLVDGADRVALEAQVKAEIRNDVLGGRYTSALTGSAPISDEMKAWVEELLDMHLVEGYGSTEAGMILIDGAIRRPAVLDYKLVDVPDLGYFLTDRPHPRGELLVKTDSLFPGYYQRAEVTADVFDADGFYRTGDIMAEVGPEQFVYLDRRNNVLKLSQGEFVTVSKLEAVFGDSPLVRQIYIYGNSARAYLLAVIVPTQEALDAVPVEELKARLGDSLQEVAKAAGLQSYEIPRDFIIETTPWTLENGLLTGIRKLARPQLKKHYGELLEQIYTDLAHGQADELRSLRQSGADAPVLVTVCRAAAALLGGSASDVQPDAHFTDLGGDSLSALSFTNLLHEIFDIEVPVGVIVSPANDLQALADYVEAARKPGSSRPTFASVHGASNGQVTEVHAGDLSLDKFIDAATLAEAPRLPAANTQVRTVLLTGATGFLGRYLALEWLERMDLVDGKLICLVRAKSDTEARARLDKTFDSGDPELLAHYRALAGDHLEVLAGDKGEADLGLDRQTWQRLADTVDLIVDPAALVNHVLPYSQLFGPNALGTAELLRLALTSKIKPYSYTSTIGVADQIPPSAFTEDADIRVISATRAVDDSYANGYSNSKWAGEVLLREAHDLCGLPVAVFRCDMILADTTWAGQLNVPDMFTRMILSLAATGIAPGSFYELAADGARQRAHYDGLPVEFIAEAISTLGAQSQDGFHTYHVMNPYDDGIGLDEFVDWLNESGCPIQRIADYGDWLQRFETALRALPDRQRHSSLLPLLHNYRQPERPVRGSIAPTDRFRAAVQEAKIGPDKDIPHVGAPIIVKYVSDLRLLGLL

SEQ ID NO: 73 - DNA, 3525 bp, Mycobacterium leprae
atgtcgactatcactaagcaggaaaagcagctcgcacgccgcgttgacgacctcaccgccaacgacccgcagttcgccgccgccaaacccgacccggcggtagccgccgcccttgcccagcccgggcttcgactgccccaaatcatccagaccgcgctggacggttacgcggagcggccggcactgggccagcgcgtcgccgagttcaccaaagaccctaagaccggacgcacctcgatggagctgctccccagctttgagaccatcacctaccgccagttgggcgaccgtgtcggagcgctggcgcgcgcctggaggcacgacctactgcacgccggctaccgggtctgcgtgctaggtttcaacagtgtcgattacgccatcatcgacatggcgctcggcgtgattggtgctgtggcggttccactgcagaccagtgcggcgatcacccagctgcagtcgatcgtgaccgagaccgaacccagtatgatcgcgacgagcgtaaaccagctgcccgatactgtcgagctgatcctgtctggccaggcgccagcgaagctcgttgtgtttgactaccaccccgaggtcgacgagcagcatgacgcagtggcaaccgcccgggcgcggttggcggacagtagcgtggtggtcgagagcctgaccgaggtcctcggtcgcggcaagacgctgccagctacgccgatccccgtggccgatgactctgctgacccgttggcgttgctgatctacacatctggcagcaccggcgcacccaagggcgcgatgtatctgcaaagcaatgtcggcaagatgtggcgccggtcagacggaaactggttcgggccaaccgccgcgtcaatcactcttaacttcatgccgatgagccacgtcatgggccgcggaatcctctacggcacgctcggtaacggcggcacggcttacttcgccgcccgcagcgacctctcgacgctgctggaggatctcaagctggtgcggccgaccgagttgaactttgtaccgcgcatctgggaaaccctctacgatgaatccaaacgcgcagttgaccgtcggttagccaacagcggctccgccgaccgtgcagccatcaaagccgaagttatggatgaacagcggcaatccctgctgggaggacggtacatcgcggctatgacgggctcggcgccaacctccccggagttgaaacacggggtcgagtccctactcgaaatgcatctgttggaaggctacggctccaccgaagccggcatggtcttgtttgacggcgaagtgcaacgtccgccggttatcgattacaagctggtcgacgttccggatttgggctacttcagcaccgaccagccttatccgagaggtgaattgctgctcaagacccagaacatgttccccggctactacaagcgtcctgaggttaccgccaccgtgttcgacagcgacggttactaccagaccggagacattgtcgccgaagtcggtcccgaccggctcgtgtacgtcgatcgccgcaacaacgtgctgaaactcgcgcagggccagttcgtcaccgtcgcgaaactcgaggcagcgttcagcaatagcccactggtccggcagatctacatctatggcaacagcgcacacccctacctgttggctgttgtggtgccgaccgaggatgcgttggctaccaatgacattgaggtgctcaaaccgctgattatcgattctttacagaaagtagcgaaagaagccgacctgcagtcctacgaggtgccgcgcgacttaatcgtcgagactacaccgttcagcctggagaatggcctgctcaccggtattcgcaagctggcgtggccgaagctcaagcagcactacggcgcgcgactcgaacagctctacgccgatctggttgaaggtcaggcaaatgcactgcacgtgctaaaacaaagcgtggcgaacgctccggtactgcagacggtgagccgagccgtgggcaccattctgggagtggcgaccaccgatttgccgtcgaatgcgcacttcaccgacttaggaggagactcgttgtccgcgctgacattcggtagcctgctacgcgaactcttcgacatcgatgtgccggtgggcgtcattgtcagccctgtcaacaacttggtggcgatcgccgactacatcgagcgcgagcggcagggcacgaagcggcccactttcattgccatacacggtcgtgacgctggcaaagtgcatgccagtgacctcactctagacaaattcatcgatgtatcaacgctgactgccgcgcccgtattggcgcaacccggcaccgaggtgcgcaccgtcctgttgaccggcgctaccggcttcctggggcgctacttggccctgaaatggctcgaacggatggacctggtcgaagggaaggtaatcgctctggtaagagccaagtccaacgaggacgctcgggcccggctcgacaagaccttcgatagcggagaccccaaactgctggcgcactaccaggaactggcaaccgaccacctggaggtcatcgccggcgacaaaggcgaagtagatctggaattggaccggcaaacgtggcgacgactggccgacacggtcgatctgatcgtcgaccccgccgccctggtcaaccacgtgctgccgtacagcgagctattcggccccaatacgttaggcaccgccgagctgattcggatcgcgctgaccagtaagcaaaagccgtacatctatgtgtcgacaatcggcgtcggtaatcagattgagccagcaaaattcaccgaagactccgacatccgagtcattagcccgacgcgcaacatcaacaacaactatgccaacggctacggcaacagcaagtgggccggcgaagtgctgctgcgcgaagctcacgacctatgcggtctgccggtcacggtcttccgctgcgacatgatcttggccgacaccagctatgccggtcagctcaacgtccccgacatgtttactcgaatgatgctgagtctagccgccaccggcatcgcacccggctcgttctacgagctagacgccgagagcaatcggcaacgcgcccactacgacggtctgcccgtcgagttcatcgccgaagcgatctccaccctgggagaccaaagcctgcacgatcgagacgggttcacgacctatcatgtaatgaacccgcacgacgacggcatcggtatggacgagtttgtggactggttaattgatgccggctgccctatacaacgcatcaacgactacgacgaatggctgcgacggtttgagatttcgctgcgcgccctgcccgaaaggcagcgtcacagctcactgttgccgttgttgcacaactaccagaagccggagaagccattgcacgggtcgctggcacccacaatccggttccgtacggccgttcaaaacgcgaacattggtcaggacaaagatattccgcatatctcgccggcaatcatcgccaaatatgtcagcgatctgcagctgctcgggctggtttga

SEQ ID NO: 74 - protein, 1174 aa, Mycobacterium leprae
MSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTAASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAQPGTEVRTVLLTGATGFLGRYLALKWLERMDLVEGKVIALVRAKSNEDARARLDKTFDSGDPKLLAHYQELATDHLEVIAGDKGEVDLELDRQTWRRLADTVDLIVDPAALVNHVLPYSELFGPNTLGTAELIRIALTSKQKPYIYVSTIGVGNQIEPAKFTEDSDIRVISPTRNINNNYANGYGNSKWAGEVLLREAHDLCGLPVTVFRCDMILADTSYAGQLNVPDMFTRMMLSLAATGIAPGSFYELDAESNRQRAHYDGLPVEFIAEAISTLGDQSLHDRDGFTTYHVMNPHDDGIGMDEFVDWLIDAGCPIQRINDYDEWLRRFEISLRALPERQRHSSLLPLLHNYQKPEKPLHGSLAPTIRFRTAVQNANIGQDKDIPHISPAIIAKYVSDLQLLGLV

SEQ ID NO: 75 - DNA, 3507 bp, Mycobacterium tuberculosis; identical to SEQ ID NO: 17

SEQ ID NO: 76 - protein, 1168 aa, Mycobacterium tuberculosis; identical to SEQ ID NO: 18

SEQ ID NO: 77 - DNA, 3468 bp, Nocardia farcinica
gtggaatccacacgagcgacgcgtctgcggcagcggatcgccgccctgtacgccgacgacgcgcaggtgcgcgacgcgcggccggacgaggcgatcagcacggcgctgcgggaaccgggcctgcggctgcgcgagctcgtcgccaccgtggtcgacggctaccgcgaccggcccgcgctggccgcgcgctcggtgcagccggccgtcgacgccgcgaccggtgcctgcgtggcacggttgctgcccgagtacacgacgatgagttacggcgagctcggcctgcggttgcgcgcggtggccgcggcctggcagcacgacgacgaaacccgccttcgccccggcgaattcgtcgcgaccctgggtttcaccagccccgactacgccgtcgtcgacctggcctgcgtgtgggcgggcgcggtggcggtgccgctgcaggcgagcgcgtcggtgacgcagctgaccgccatcctggccgagaccgcgcccgcaatcctggccaccggcctggacacgctgccgcacgcggtggactgtgtgctcgccggggccacgccacgggcactgcacgtgttcgacttcgaccccgccatcgacgcgcagcgcacggtgtacgaggcggcgtgtgcgcggctggccggtaccggtgtgcgcgtgcgcacgctcgccgaggtcgaggaccgcggccgggcgctgccgcctgccgtgatcgacgacggccccggcgacgaccggctcgccctgttgatctacacctccggcagtaccggcacgcccaagggggcgatgtacaccgagcggctggtcgcgctgatgtggctgggccagccgcaggtcgccgcgctcaccgtcaactacctgccgctcagccacgtcgccgggcggctggcgctgttcgggctgctcgcgcgcggcggcaccgcctacttcaccgcgcgcgccgacatgtccacgctgttcgaggatctggcgctggccaggccgaccgagctgttcgtggtgccgcgcgtgtgcgagatggtgctgcaacgattccagaccgagcggctgcggcgccaggccgacgacgaccgggtcaaggccgacctgcgcctcgaactgttcggcgaccggctgctctcggtggtgtgcggcagcgcgccgctggccccggagctgaaggcgttcatggaatcggtgctcgacctgaccctgcacgacggctacggctccaccgaggcgggcggcagcgtggtcatcgacaccaccgtgcgcaggccgccggtgctggactaccggctcgccgacgtgcccgaactgggctatttccgtaccgacaagccgcatccgcgcggcgagctgctgctcaagaccaccaccatgatccccggctactaccggcggccggagctcaacgcccagatcttcgacgaggacggcttctaccgcaccggcgacgtggtcgcggaactggcgccggaccggctcgtgtacgtcgatcgccgcaacaatgtgctcaagctggcgcagggcgagttcgtcaccatcgcccggctggaggcgatcttcgccaacagtccgctggtgcgccagatcttcgtctacggcaacagcgaacgcgcctatctgctggcggtgatcgtgccgagccgacaggcgatggcgggcgatccggccacgctgaagacgcggatcgcggagtcgttgcagctcatcggccgggacgccgagctggaggcctacgagatcccgcgcgacttcctgatcgagaccgagccgttcaccaccgaatccgggctgctctcgggcatcggcaagatcctgcgtcccgccgtcgaggcgcgctatcgcgaccggctcgaacagctctacgccgacctggccgcggcccagcaggacgagctggcggcgctgcgccgcgaggccgggcagcgtccggtgctcgagaccgtcacccgcgcggccgccgcgatcctcggcggcacggcgagcgacctgagcccggccgcgcacttcaccgatctcggcggcgattcgctggcggcgctggcgctgtcgaacctgctgcgtgagatcttcgccgtcgaggtgccggtcggcgtcatcaccggccccgcgaccgacctccgtggcctggccgcccacatcgccgcggaacgcgaaaaccgcaccgagacaccgctgttcgaccgggtgcatcccgaccagatcctgatccgggccaccgacctcgccctggagaagttcttcgacgccgaggagttggccgccgcggccaccgccgcgccgccggtcgccgagccccgggtggtgctgctgaccggtgccaacggctatctcggccggtttctgtgcctggaatggctggaacggctcgaccgcgtcgacggacggctgatctgcctggtgcgcggcgcggacgaggccgccgcgctggcccgcctggaagccgccttcgacagcggcgatcccgaattggtgcgccgcttcaaggaattggcccagcgcaggctcaccgtggtggccggcgacatcggcgagcccggcctgggcctggccaccgccacgtggcgacggctcgccgccgaggtcgagcacatcgtgcacccggccgcgctggtcaaccacgtgctgccctaccggcagctgttcgggcccaacgtggcgggcaccgcggagatcctgcggctcgcgctcaccgagcggcgcaagccgatcgacttcctgtccacggtcgccgttgccgcgcagatacccgccgaccggttcgccgaggacggcgacatccgcgtgatcagcccgacccgcacggtggaccgcggctacgccaacggctacggcaacagcaaatgggccgccgaggtgttgctgcgtgcggcgcacgaccgcttcgatctcccggtggcggtgttccgctcggacatgatcctggcccacggcagcttcgccggacagctcaacatccccgacgtgttcacccggctgctgctcagcctgctggtcaccggtatcgcgcccgcctcgttccacgccgcgacggtcaccggcgagcgcccgcgcgcccactacgacgggctgcccgcggacttcaccgctgccgcgatcaccgcgctcggggcgcgcaccgcgggattccacacctacgacgtgctcaacccgcacgacgacggcatcagcctggacaccttcgtggactggctgatcgaggccggacatcccatcgaacgcatccccgagcacagcgagtgggtcacccgtttcgagacggcgttgcacgccctgcccgaacgtcagcgcaaacactcgctgctcccgctgttgcacgcctaccgcaggccggtgcccgcgctgcgcggctcggcgctgcccgccgcggagttccgggcggcggtgcgggccgcaggcatcaccgccgacggtgacatcccgcacctgacgcgcgcgctgatcgagaagtacgtcgccgatctccgcctgcacggactgttgtag

SEQ ID NO: 78 - protein, 1155 aa, Nocardia farcinica
VESTRATRLRQRIAALYADDAQVRDARPDEAISTALREPGLRLRELVATVVDGYRDRPALAARSVQPAVDAATGACVARLLPEYTTMSYGELGLRLRAVAAAWQHDDETRLRPGEFVATLGFTSPDYAVVDLACVWAGAVAVPLQASASVTQLTAILAETAPAILATGLDTLPHAVDCVLAGATPRALHVFDFDPAIDAQRTVYEAACARLAGTGVRVRTLAEVEDRGRALPPAVIDDGPGDDRLALLIYTSGSTGTPKGAMYTERLVALMWLGQPQVAALTVNYLPLSHVAGRLALFGLLARGGTAYFTARADMSTLFEDLALARPTELFVVPRVCEMVLQRFQTERLRRQADDDRVKADLRLELFGDRLLSVVCGSAPLAPELKAFMESVLDLTLHDGYGSTEAGGSVVIDTTVRRPPVLDYRLADVPELGYFRTDKPHPRGELLLKTTTMIPGYYRRPELNAQIFDEDGFYRTGDVVAELAPDRLVYVDRRNNVLKLAQGEFVTIARLEAIFANSPLVRQIFVYGNSERAYLLAVIVPSRQAMAGDPATLKTRIAESLQLIGRDAELEAYEIPRDFLIETEPFTTESGLLSGIGKILRPAVEARYRDRLEQLYADLAAAQQDELAALRREAGQRPVLETVTRAAAAILGGTASDLSPAAHFTDLGGDSLAALALSNLLREIFAVEVPVGVITGPATDLRGLAAHIAAERENRTETPLFDRVHPDQILIRATDLALEKFFDAEELAAAATAAPPVAEPRVVLLTGANGYLGRFLCLEWLERLDRVDGRLICLVRGADEAAALARLEAAFDSGDPELVRRFKELAQRRLTVVAGDIGEPGLGLATATWRRLAAEVEHIVHPAALVNHVLPYRQLFGPNVAGTAEILRLALTERRKPIDFLSTVAVAAQIPADRFAEDGDIRVISPTRTVDRGYANGYGNSKWAAEVLLRAAHDRFDLPVAVFRSDMILAHGSFAGQLNIPDVFTRLLLSLLVTGIAPASFHAATVTGERPRAHYDGLPADFTAAAITALGARTAGFHTYDVLNPHDDGISLDTFVDWLIEAGHPIERIPEHSEWVTRFETALHALPERQRKHSLLPLLHAYRRPVPALRGSALPAAEFRAAVRAAGITADGDIPHLTRALIEKYVADLRLHGLL

SEQ ID NO: 79 - DNA, 3525 bp, Nocardia sp.; identical to SEQ ID NO: 15

SEQ ID NO: 80 - protein, 1174 aa, Nocardia sp.; identical to SEQ ID NO: 16

SEQ ID NO: 81 - DNA, 3522 bp, Mycobacterium avium
atgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccatcacgtacagcgaagtagcgcagcgtgtttcggcgctgggccgcgccctgtccgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccagcaccggcgtggccgtccagacgctggccgagctgctggagcgcggcaaggacctgcccgccgtcgcggagccgcccgccgacgaggactcgctggccctgctgatctacacctccgggtccaccggcgcccccaagggcgcgatgtacccacagagcaacgtcggcaagatgtggcgccgcggcagcaagaactggttcggcgagagcgccgcgtcgatcaccctgaacttcatgccgatgagccacgtgatgggccgaagcatcctctacggcacgctgggcaacggcggcaccgcctacttcgccgcccgcagcgacctgtccaccctgcttgaggacctcgagctggtgcggcccaccgagctcaacttcgtcccgcggatctgggagacgctgtacggcgaattccagcgtcaggtcgagcggcggctctccgaggccggggacgccggcgaacgtcgcgccgtcgaggccgaggtgctggccgagcagcgccagtacctgctgggcgggcggttcaccttcgcgatgacgggctcggcgcccatctcgccggagctgcgcaactgggtcgagtcgctgctcgaaatgcacctgatggacggctacggctccaccgaggccggaatggtgttgttcgacggggagattcagcgcccgccggtgatcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccaacgagctggccgagctgcgccgcaacggtgcccaggcgccggtgttgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtaggcgtgatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgagacgctggccgccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaaactgctcgcgcactaccagcagctggccgccgatcacctggaggtcatcgccggcgacaagggcgaggccaatctgggcctgggccaagacgtttggcaacgactggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctatggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcgtcggtctggacgagtacgtcgattggctggtggacgccggctattcgatcgagcggatcgccgactactccgaatggctgcggcggttcgagacctcgctgcgggccctgccggaccggcagcgccagtactcgctgctgccgctgctgcacaactaccgcacgccggagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctga

SEQ ID NO: 82 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYSEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGVGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 83 - DNA, 3507 bp, Mycobacterium tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccttggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatccgcccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 84 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIRPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 85 - DNA, 3507 bp, Mycobacterium bovis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctactacgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctactcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacacctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 86 - protein, 1168 aa, Mycobacterium bovis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYYVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHTSLLPLLHNYREPAKPICGSIAPTDQFRAAVQEAKIGPDKDIPHLTAAIIAKYISNLRLLGLL

SEQ ID NO: 87 - DNA, 3567 bp, Mycobacterium leprae
gtgtggcgccaacagtctatttctcatcgcaaggaatctgttatgtcgactatcactaagcaggaaaagcagctcgcacgccgcgttgacgacctcaccgccaacgacccgcagttcgccgccgccaaacccgacccggcggtagccgccgcccttgcccagcccgggcttcgactgccccaaatcatccagaccgcgctggacggttacgcggagcggccggcactgggccagcgcgtcgccgagttcaccaaagaccctaagaccggacgcacctcgatggagctgctccccagctttgagaccatcacctaccgccagttgggcgaccgtgtcggagcgctggcgcgcgcctggaggcacgacctactgcacgccggctaccgggtctgcgtgctaggtttcaacagtgtcgattacgccatcatcgacatggcgctcggcgtgattggtgctgtggcggttccactgcagaccagtgcggcgatcacccagctgcagtcgatcgtgaccgagaccgaacccagtatgatcgcgacgagcgtaaaccagctgcccgatactgtcgagctgatcctgtctggccaggcgccagcgaagctcgttgtgtttgactaccaccccgaggtcgacgagcagcatgacgcagtggcaaccgcccgggcgcggttggcggacagtagcgtggtggtcgagagcctgaccgaggtcctcggtcgcggcaagacgctgccagctacgccgatccccgtggccgatgactctgctgacccgttggcgttgctgatctacacatctggcagcaccggcgcacccaagggcgcgatgtatctgcaaagcaatgtcggcaagatgtggcgccggtcagacggaaactggttcgggccaaccgccgcgtcaatcactcttaacttcatgccgatgagccacgtcatgggccgcggaatcctctacggcacgctcggtaacggcggcacggcttacttcgccgcccgcagcgacctctcgacgctgctggaggatctcaagctggtgcggccgaccgagttgaactttgtaccgcgcatctgggaaaccctctacgatgaatccaaacgcgcagttgaccgtcggttagccaacagcggctccgccgaccgtgcagccatcaaagccgaagttatggatgaacagcggcaatccctgctgggaggacggtacatcgcggctatgacgggctcggcgccaacctccccggagttgaaacacggggtcgagtccctactcgaaatgcatctgttggaaggctacggctccaccgaagccggcatggtcttgtttgacggcgaagtgcaacgtccgccggttatcgattacaagctggtcgacgttccggatttgggctacttcagcaccgaccagccttatccgagaggtgaattgctgctcaagacccagaacatgttccccggctactacaagcgtcctgaggttaccgccaccgtgttcgacagcgacggttactaccagaccggagacattgtcgccgaagtcggtcccgaccggctcgtgtacgtcgatcgccgcaacaacgtgctgaaactcgcgcagggccagttcgtcaccgtcgcgaaactcgaggcagcgttcagcaatagcccactggtccggcagatctacatctatggcaacagcgcacacccctacctgttggctgttgtggtgccgaccgaggatgcgttggctaccaatgacattgaggtgctcaaaccgctgattatcgattctttacagaaagtagcgaaagaagccgacctgcagtcctacgaggtgccgcgcgacttaatcgtcgagactacaccgttcagcctggagaatggcctgctcaccggtattcgcaagctggcgtggccgaagctcaagcagcactacggcgcgcgactcgaacagctctacgccgatctggttgaaggtcaggcaaatgcactgcacgtgctaaaacaaagcgtggcgaacgctccggtactgcagacggtgagccgagccgtgggcaccattctgggagtggcgaccaccgatttgccgtcgaatgcgcacttcaccgacttaggaggagactcgttgtccgcgctgacattcggtagcctgctacgcgaactcttcgacatcgatgtgccggtgggcgtcattgtcagccctgtcaacaacttggtggcgatcgccgactacatcgagcgcgagcggcagggcacgaagcggcccactttcattgccatacacggtcgtgacgctggcaaagtgcatgccagtgacctcactctagacaaattcatcgatgtatcaacgctgactgccgcgcccgtattggcgcaacccggcaccgaggtgcgcaccgtcctgttgaccggcgctaccggcttcctggggcgctacttggccctgaaatggctcgaacggatggacctggtcgaagggaaggtaatcgctctggtaagagccaagtccaacgaggacgctcgggcccggctcgacaagaccttcgatagcggagaccccaaactgctggcgcactaccaggaactggcaaccgaccacctggaggtcatcgccggcgacaaaggcgaagtagatctggaattggaccggcaaacgtggcgacgactggccgacacggtcgatctgatcgtcgaccccgccgccctggtcaaccacgtgctgccgtacagcgagctattcggccccaatacgttaggcaccgccgagctgattcggatcgcgctgaccagtaagcaaaagccgtacatctatgtgtcgacaatcggcgtcggtaatcagattgagccagcaaaattcaccgaagactccgacatccgagtcattagcccgacgcgcaacatcaacaacaactatgccaacggctacggcaacagcaagtgggccggcgaagtgctgctgcgcgaagctcacgacctatgcggtctgccggtcacggtcttccgctgcgacatgatcttggccgacaccagctatgccggtcagctcaacgtccccgacatgtttactcgaatgatgctgagtctagccgccaccggcatcgcacccggctcgttctacgagctagacgccgagagcaatcggcaacgcgcccactacgacggtctgcccgtcgagttcatcgccgaagcgatctccaccctgggagaccaaagcctgcacgatcgagacgggttcacgacctatcatgtaatgaacccgcacgacgacggcatcggtatggacgagtttgtggactggttaattgatgccggctgccctatacaacgcatcaacgactacgacgaatggctgcgacggtttgagatttcgctgcgcgccctgcccgaaaggcagcgtcacagctcactgttgccgttgttgcacaactaccagaagccggagaagccattgcacgggtcgctggcacccacaatccggttccgtacggccgttcaaaacgcgaacattggtcaggacaaagatattccgcatatctcgccggcaatcatcgccaaatatgtcagcgatctgcagctgctcgggctggtttga

SEQ ID NO: 88 - protein, 1188 aa, Mycobacterium leprae
VWRQQSISHRKESVMSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTAASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAQPGTEVRTVLLTGATGFLGRYLALKWLERMDLVEGKVIALVRAKSNEDARARLDKTFDSGDPKLLAHYQELATDHLEVIAGDKGEVDLELDRQTWRRLADTVDLIVDPAALVNHVLPYSELFGPNTLGTAELIRIALTSKQKPYIYVSTIGVGNQIEPAKFTEDSDIRVISPTRNINNNYANGYGNSKWAGEVLLREAHDLCGLPVTVFRCDMILADTSYAGQLNVPDMFTRMMLSLAATGIAPGSFYELDAESNRQRAHYDGLPVEFIAEAISTLGDQSLHDRDGFTTYHVMNPHDDGIGMDEFVDWLIDAGCPIQRINDYDEWLRRFEISLRALPERQRHSSLLPLLHNYQKPEKPLHGSLAPTIRFRTAVQNANIGQDKDIPHISPAIIAKYVSDLQLLGLV

SEQ ID NO: 89 - DNA, 3816 bp, Dictyostelium discoideum
atgttaaaacatattaaaaattttttaactagaaaagaagaaagaaaagaaaaagaagtagagaaattaaaagatggagtatcaataactgaggttaaacaatcgaacctagtagtttattcatgcaatggttgtggatcagagatatggccaccaaaacaagagagatatgcatgtaatgaatgctcaaatttcgatttatgtagtgagtgttatagaaaagaaatgatattaataaatggtacacaagaagagaaagataaattagttagtggggagagtaataatggaataaagtacgagccagtgagacattatgatccatcaccattacctcatcaattaacattagagaatgagactcaatttcaattagtttatagtttacgtggtaattcaacatttgaaacaatggagaaatcatttaaatactttaaaaacagaccatgtcttggtattagagagagattaggagaggataatgttttatcagaaagatataaatggttaacatatggtgaagtgtatgagaaatctttaaccttggcaaaggcattaactaatttcatcgaaagaagagatttcatttcaatctatatggataattgcttagaatggtatttcacagattttgcatcattatgggccggattaatagtggtaccattacatcatgcttcaaatagttttaatcttttagagattctttggaattccgaatcaaaatgtatagtttgttctggtgaatcatttaaaaatttaatagaactttatgatcaattgactgagcaagataaattagagaaaccaatagtgttgaaattgatagttcataaggaggatctattcgatcagtcattagtcgatagattgccaagtggcgtagaatttaaaactttcaatgagatgattaaaattggggaatcattaagtcaggctaaatatgaatttgtcccagttggtccaaatgatctttcctcggtgacttatacaagtggtagtactggtgtaccaaaaggtgtaatgaagttagattcaattttcaatttactaattgtcaattcctatgttcaattcccaaatgcagtttatagttataataccctatcacatagtcaacgtttaagtgattggagatatatttatatgggtggtagagtagctatctattcaggtgatatgaatctattatttgaagatttagccttggttagacctcattcattttgggctgtaccaagattttggaatttattattcacccagttcaagagtgatctaaagcaatacatgtttgaaaatccacaattggatgaaagaactgccacactctattgctataaaggtattagaaagttattaggtgatagaattaataatctagtgactggtggtgctccgactgcaaatgaagtactcaaatttatgagtgattgttggaaagatataaacatttcaaattcttatggtttaactgaagtatcaggtgtttgtatagatggttatatctctgacgaagtagaattcaaaattgaaccagtaccttcttttggatattacccaactgatttaccacatcctcgtggtgaattggttgtaaaatcatcaacaatgtctgcaggttattataaaaatactcaattaacttcagaatcatttgaaggtggttggtttaaaactggtgatgtcgtagaattaattggagttagaaaagttaaaatcattgatagaattaaacatgccttcaaattggcaaatggagaattcgttacaccagaaccattggaaaataatttcgtttcactttgtattaatcaaatttttatttatggtaattcacttaaaacatttttagttgcaattgttaaaccatcacaagattgtttaaaacaattaggacttcaagatataccaatcgatcaattaattgaaaatccaactttaaaatcaaaacttttatcagagattaataaaatttcaaaagaaaaaaaactagcaaattatgaaattccaaaaattattacaatagatttcactgaatggacaattgataataaattaatcactggttctggtaaatttaatagaggtgaattatataaattttataaaattaaaattaataatatgtttgatataattgataaaattcaacaaggtttaagaaataataataataataataataatgataatattaataataatgataataataataataatgaatcaaataaagataattttgaaaattatataaaatcaattttaaatttagacggtagaattgaagataataattttaatttagagaatttatcatttattcaaattggtggtgattcgttaggtgctgttaaattatcatcacttttaaaagaaaaagaaaatattgatatttcaccttcaacaattttaaatcaaaattttaatttatcttcattatcgaaattaataaatgaaaaagaatcaaatcaatcaattgttgaagattttaaagaaaattttaaaatcaattggaatgaagagatgattttagatgaagatattaaaaaatcaattgaccaaattaaaaatgcacaaccatcatcaactccctcttcatcaaaatcaacaccatcacaatcatcatcatcaccaccaccatcattaaattcaaataatattggtcaaaatgcttttcatatgaaatcaatatttattacaggtgttacaggttatttaggtacatttttattatttaatttattagaggataaatcaattggtattgagagaatttattgtttagttagaaatgtaaagaatgaagaagaaggttttaaattaattgaaagaatatttgaaaaatcttgtatcaatggtatgaatgaaaagattagagaaaaggtaattccagtttgtggtgacttatcaaaaccatttttcggtgtttctactgaaaccttcaaaatgttatctttagcggtcgatatggtaattcacaatggtgccattgttaatatggcctatccatatgcgaatatgaaatcaacaaatgttacatcaactcgtgatatcctaagattatgcactaccggaagagcctcttttaaaaagttggtctacgtttcaacagttggtgtattctttggaaatggtgatgaaaagatagatgaatcaacagcaccatcaactttctttttagatcatggtaatggttataaccaaacaaaactaatatcagatatacttgttagagaagcggcttcatatggtttaccaacaatgattttcagaccaggtacaatctttagtcatacccaatctggtttcaacaatcaaaatgattcaatcggtttaataattaaaggtatcctaggttcgagttcctatccaactaaaaaagattactctagtggcgatttaaatctttcaccagttgattgggtatcatcttcaatggtttctttaattaagcatcttccattttggtgtaataatacaaaaatttatcatatggtaaatgataatcgtttatctttagatttgctatgtcaatatataaataaagaaaaacaattagaagaaattaattatttcgattggatcgatgctcaacttaattcttcaaataatccattgtattctattaaacatttatttaaaaagaatgatcgtttcccaattggttctcagtcaattaaaaatccaaaaactattaaagatttagaatcaattggtgaacttcaatgtcaaccaatatctgattccacagtaatcaattatgtaaaatatttaatctcaaataatttaattcaaacaattaataaataa

SEQ ID NO: 90 - protein, 1271 aa, Dictyostelium discoideum
MLKHIKNFLTRKEERKEKEVEKLKDGVSITEVKQSNLVVYSCNGCGSEIWPPKQERYACNECSNFDLCSECYRKEMILINGTQEEKDKLVSGESNNGIKYEPVRHYDPSPLPHQLTLENETQFQLVYSLRGNSTFETMEKSFKYFKNRPCLGIRERLGEDNVLSERYKWLTYGEVYEKSLTLAKALTNFIERRDFISIYMDNCLEWYFTDFASLWAGLIVVPLHHASNSFNLLEILWNSESKCIVCSGESFKNLIELYDQLTEQDKLEKPIVLKLIVHKEDLFDQSLVDRLPSGVEFKTFNEMIKIGESLSQAKYEFVPVGPNDLSSVTYTSGSTGVPKGVMKLDSIFNLLIVNSYVQFPNAVYSYNTLSHSQRLSDWRYIYMGGRVAIYSGDMNLLFEDLALVRPHSFWAVPRFWNLLFTQFKSDLKQYMFENPQLDERTATLYCYKGIRKLLGDRINNLVTGGAPTANEVLKFMSDCWKDINISNSYGLTEVSGVCIDGYISDEVEFKIEPVPSFGYYPTDLPHPRGELVVKSSTMSAGYYKNTQLTSESFEGGWFKTGDVVELIGVRKVKIIDRIKHAFKLANGEFVTPEPLENNFVSLCINQIFIYGNSLKTFLVAIVKPSQDCLKQLGLQDIPIDQLIENPTLKSKLLSEINKISKEKKLANYEIPKIITIDFTEWTIDNKLITGSGKFNRGELYKFYKIKINNMFDIIDKIQQGLRNNNNNNNNDNINNNDNNNNNESNKDNFENYIKSILNLDGRIEDNNFNLENLSFIQIGGDSLGAVKLSSLLKEKENIDISPSTILNQNFNLSSLSKLINEKESNQSIVEDFKENFKINWNEEMILDEDIKKSIDQIKNAQPSSTPSSSKSTPSQSSSSPPPSLNSNNIGQNAFHMKSIFITGVTGYLGTFLLFNLLEDKSIGIERIYCLVRNVKNEEEGFKLIERIFEKSCINGMNEKIREKVIPVCGDLSKPFFGVSTETFKMLSLAVDMVIHNGAIVNMAYPYANMKSTNVTSTRDILRLCTTGRASFKKLVYVSTVGVFFGNGDEKIDESTAPSTFFLDHGNGYNQTKLISDILVREAASYGLPTMIFRPGTIFSHTQSGFNNQNDSIGLIIKGILGSSSYPTKKDYSSGDLNLSPVDWVSSSMVSLIKHLPFWCNNTKIYHMVNDNRLSLDLLCQYINKEKQLEEINYFDWIDAQLNSSNNPLYSIKHLFKKNDRFPIGSQSIKNPKTIKDLESIGELQCQPISDSTVINYVKYLISNNLIQTINK

SEQ ID NO: 91 - DNA, 3333 bp, Streptomyces rimosus
atgaccgacacgtacgtttcttcacgcccgttatccaagcggccccaggtcccgggtgcccgcacgccggcgcccggctacccacgggacagccgcatcccggagctgttcgaggcacaggccgcggcgctgccgcaggccccggcggcccggcacggggaccgcaccctgacctacggccaactcgacgcccacgccgacgcgttggcggaccggctggctgccggcggggtccggccgggtgacctgatcggcgtgtgcggcagccgttccctggaggcgctggtggcgctgctgggcatcctcaaggccggctgcgcgtacgtaccgctcgacgaggaactgccgccggcccggctgcgggccatggccgaggacgcgggcatcagcgccgcggtcaccctgccgggcagcacgcgccgggtgcggggtctacgcgtgtcagtcgaggtcggctccctcggccggcccgcccccgagcgcgcgagcggccccgcccccgaccgggccaccggctccgccgccgactgcgcctacgtcgccttcacttccggcacgaccggccggcccaagcccgtagcgctgtcccaccggggcgtggtccgcctcgtgctgtccgaccccggcctcacgccacccggaccgggcgacggagtgctgcacgcctacagcctgtcctccgacgcctcgaccatcgagatctggggcgcgctgctgaccggcgcctgcctggtcgtcgccgaccgcgaggaactgctctcgcccaccgccctggaacggctgctccgcgcgggcggcgtcaccgtggcgtacctgacgacgagcgtcttccacctcgtcgcccggacccgccccgaggcgctggccggcctgcggttcgtctccgcgggcggggaggcgatggacccgcgcctggcgaacgccgtcctcgcggcctgcccccgcaccacggtggtcaacttctacggcccgaccgagaacgccgtggtctccaccgcccatgtgctcacccccctccccgaggacgccgcacacgtccccctgggacgccccttcggcgcttccacctgccacgtcctgcgggccgacggctcgcccgcgcggccgggcgaggaaggggagctgtacgtcggcggggacgggctggcgctgggctacctcggcgacccgcagctgaccgccgagcggttcgtgacgctgcccgcggtcgagccggacggaccgctgtaccggaccggcgaccgggccgtacggcacgccgacgggctgctggagtaccgcggacggctcgaccgccaggtcaagctgcgcggcgcccgcatcgagctggacgaggtggagacccgcttacgggcccaccccgaggtcggcgaagcggccgtcgaggtcgacgggcactccctgaccgcctacgtcacggccaccgtccccggccgcccgctgccgctggccgacctgcgcgcgtactgcgccaagtggctgcccccgcaggccgtcccggccctgatacccctggaccgcttcccggtcaccagcggcggcaagatcgaccgcagccgtctgaagccgaccgcgccaccgcccggccccgaagacaccgcggaggccgcgcggcgcccggacgagccggaggccaccgacggcctgtccggtctcctctcggaagtgtggcaccaggtgctgcgtgtccggcccacgccccgggacgacttcttcctcctcggcggcgactccctgctcgcctcggagaccgtcacccgcaccctcgccgtactcggcctcgacgcggccctgggctccaccctcatcagggcgctgctggccgcgcccaccctcgaaagcttcaccgccgccgtacgcggagtccgcggcggcaccggcggaccggccggcggccaggaaccggccgtcgacttcgccgcggagaccggactcggcttcgccctcccgcccgccgaaggcccggcgccgaacccgcacgaccccgaggacgtcctgctcacgggcgcttccggcttcgtcggcggattcctgctgcaccgtctgctgcacgcgacggccgcccgcgtccactgccccgtacgggcgacgagccccgcccacgcccggcagcgggtccgcaccgccctcacccgctacgggctgcacctcgacgaggccgactggcagcgcgtggagtgcttccccggggacctgacccagccgcgcctggggctcgaccacgagcgcgccgacgcactggcccagcgcctggacctgatcgtgcacaacggtgcccgggtcaacttcctctacccctaccagcagttgcgcccggcgaacgtcgacggaacccgcgaggtcgtccggatcgccgcgcgccgccgggtgccggtgcacttcgtgtccaccgtcgcagtcgtcgcgggcttcggcaccgccggggtgcgcgaggtggacgaagatctgccgccggcccacgccgacgggctgaccatggggtacgcggagagcaagtgggtcgccgaaggggtgctgcggcaggcggccgcgcagggcctgccggtggccgtgtaccggccgtacgaggtcacgggcgaccggacgcacggcgcgtgcaacaccgagacggccatctgctcgctgttcaagatgatcgccgacacgggagtggcccccgacatcaagctgccgatggacttcgtacccgtcgaccacctcgccgagtccctggtgcacatcgccacgcaccggccggccgacggccgggtctaccacctgaccaacccgcgcccggcgatgctgtcggacgtcctcgaccggatgcgcgcggcgggcttcaccctgcgcaccctgccgtacgacgcgtgggtcggcgagctcgtccggcacgtcgccgagaacccgacgagcgccacggctccgttcgtgtccctgtgcgtggaccgcagccgcaccgccgacatgtccgtcaaggagatgtacctcaagggcaccttcccggtcctggggcggcgcaacgccgaggaggcgctggccggcagcgggctgcactgcccgccggtcgactccgctctgctggaccgctacctggagtacttcttcacctccggctacctcacgcgcccggcggccggccccgggcccgaatccgaggccgagcgaataccggaggacgagccggtgtccgggaccgaaccgatatccgggaccgaaccgatttctgccgccgagccgatatccgggaccgaaccgatttctgccgccgggccgatatccgggaccgagccgatacccgccgccgagccgatatccgggaccgcagccgcagcccgcacggagcgcagccgatga

SEQ ID NO: 92 - protein, 1110 aa, Streptomyces rimosus
MTDTYVSSRPLSKRPQVPGARTPAPGYPRDSRIPELFEAQAAALPQAPAARHGDRTLTYGQLDAHADALADRLAAGGVRPGDLIGVCGSRSLEALVALLGILKAGCAYVPLDEELPPARLRAMAEDAGISAAVTLPGSTRRVRGLRVSVEVGSLGRPAPERASGPAPDRATGSAADCAYVAFTSGTTGRPKPVALSHRGVVRLVLSDPGLTPPGPGDGVLHAYSLSSDASTIEIWGALLTGACLVVADREELLSPTALERLLRAGGVTVAYLTTSVFHLVARTRPEALAGLRFVSAGGEAMDPRLANAVLAACPRTTVVNFYGPTENAVVSTAHVLTPLPEDAAHVPLGRPFGASTCHVLRADGSPARPGEEGELYVGGDGLALGYLGDPQLTAERFVTLPAVEPDGPLYRTGDRAVRHADGLLEYRGRLDRQVKLRGARIELDEVETRLRAHPEVGEAAVEVDGHSLTAYVTATVPGRPLPLADLRAYCAKWLPPQAVPALIPLDRFPVTSGGKIDRSRLKPTAPPPGPEDTAEAARRPDEPEATDGLSGLLSEVWHQVLRVRPTPRDDFFLLGGDSLLASETVTRTLAVLGLDAALGSTLIRALLAAPTLESFTAAVRGVRGGTGGPAGGQEPAVDFAAETGLGFALPPAEGPAPNPHDPEDVLLTGASGFVGGFLLHRLLHATAARVHCPVRATSPAHARQRVRTALTRYGLHLDEADWQRVECFPGDLTQPRLGLDHERADALAQRLDLIVHNGARVNFLYPYQQLRPANVDGTREVVRIAARRRVPVHFVSTVAVVAGFGTAGVREVDEDLPPAHADGLTMGYAESKWVAEGVLRQAAAQGLPVAVYRPYEVTGDRTHGACNTETAICSLFKMIADTGVAPDIKLPMDFVPVDHLAESLVHIATHRPADGRVYHLTNPRPAMLSDVLDRMRAAGFTLRTLPYDAWVGELVRHVAENPTSATAPFVSLCVDRSRTADMSVKEMYLKGTFPVLGRRNAEEALAGSGLHCPPVDSALLDRYLEYFFTSGYLTRPAAGPGPESEAERIPEDEPVSGTEPISGTEPISAAEPISGTEPISAAGPISGTEPIPAAEPISGTAAAARTERSR

SEQ ID NO: 93 - DNA, 1020 bp, Escherichia coli
atgtcgatgataaaaagctatgccgcaaaagaagcgggcggcgaactggaagtttatgagtacgatcccggtgagctgaggccacaagatgttgaagtgcaggtggattactgcgggatctgccattccgatctgtcgatgatcgataacgaatggggattttcacaatatccgctggttgccgggcatgaggtgattgggcgcgtggtggcactcgggagcgccgcgcaggataaaggtttgcaggtcggtcagcgtgtcgggattggctggacggcgcgtagctgtggtcactgcgacgcctgtattagcggtaatcagatcaactgcgagcaaggtgcggtgccgacgattatgaatcgcggtggctttgccgagaagttgcgtgcggactggcaatgggtgattccactgccagaaaatattgatatcgagtccgccgggccgctgttgtgcggcggtatcacggtctttaaaccactgttgatgcaccatatcactgctaccagccgcgttggggtaattggtattggcgggctggggcatatcgctataaaacttctgcacgcaatgggatgcgaggtgacagcctttagttctaatccggcgaaagagcaggaagtgctggcgatgggtgccgataaagtggtgaatagccgcgatccgcaggcactgaaagcactggcggggcagtttgatctcattatcaacaccgtcaacgtcagcctcgactggcagccctattttgaggcgctgacctatggcggtaatttccatacggtcggtgcggttctcacgccgctgtctgttccggcctttacgttaattgcgggcgatcgcagcgtctctggttctgctaccggcacgccttatgagctgcgtaagctgatgcgttttgccgcccgcagcaaggttgcgccgaccaccgaactgttcccgatgtcgaaaattaacgacgccatccagcatgtgcgcgacggtaaggcgcgttaccgcgtggtgttgaaagccgatttttga

SEQ ID NO: 94 - protein, 339 aa, Escherichia coli
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 95 - DNA, 1050 bp, Escherichia coli
atgaagatcaaagctgttggtgcatattccgctaaacaaccacttgaaccgatggatatcacccggcgtgaaccgggaccgaatgatgtcaaaatcgaaatcgcttactgtggcgtttgccattccgatctccaccaggtccgttccgagtgggcggggacggtttacccctgcgtgccgggtcatgaaattgtggggcgtgtggtagccgttggtgatcaggtagaaaaatatgcgccgggcgatctggtcggtgtcggctgcattgtcgacagttgtaaacattgcgaagagtgtgaagacgggttggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggattaagctggcccacgcgatgggggcacatgtggtggcatttaccacttctgaggcaaaacgcgaagcggcaaaagccctgggggccgatgaagttgttaactcacgcaatgccgatgagatggcggctcatctgaagagtttcgatttcattttgaatacagtagctgcgccacataatctcgacgattttaccaccttgctgaagcgtgatggcaccatgacgctggttggtgcgcctgcgacaccgcataaatcgccggaagttttcaacctgatcatgaaacgccgtgcgatagccggttctatgattggcggcattccagaaactcaggagatgctcgatttttgcgccgaacatggcatcgtggctgatatagagatgattcgggccgatcaaattaatgaagcctatgagcgaatgctgcgcggtgatgtgaaatatcgttttgttatcgataatcgcacactaacagactga

SEQ ID NO: 96 - protein, 349 aa, Escherichia coli
MKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 97 - DNA, 1011 bp, Escherichia coli
atgaaggctgcagttgttacgaaggatcatcatgttgacgttacgtataaaacactgcgctcactgaaacatggcgaagccctgctgaaaatggagtgttgtggtgtatgtcataccgatcttcatgttaagaatggcgattttggtgacaaaaccggcgtaattctgggccatgaaggcatcggtgtggtggcagaagtgggtccaggtgtcacctcattaaaaccaggcgatcgtgccagcgtggcgtggttctacgaaggatgcggtcattgcgaatactgtaacagtggtaacgaaacgctctgccgttcagttaaaaatgccggatacagcgttgatggcgggatggcggaagagtgcatcgtggtcgccgattacgcggtaaaagtgccagatggtctggactcggcggcggccagcagcattacctgtgcgggagtcaccacctacaaagccgttaagctgtcaaaaattcgtccagggcagtggattgctatctacggtcttggcggtctgggtaacctcgccctgcaatacgcgaagaatgtctttaacgccaaagtgatcgccattgatgtcaatgatgagcagttaaaactggcaaccgaaatgggcgcagatttagcgattaactcacacaccgaagacgccgccaaaattgtgcaggagaaaactggtggcgctcacgctgcggtggtaacagcggtagctaaagctgcgtttaactcggcagttgatgctgtccgtgcaggcggtcgtgttgtggctgtcggtctaccgccggagtctatgagcctggatatcccacgtcttgtgctggatggtattgaagtggtcggttcgctggtcggcacgcgccaggatttaactgaagccttccagtttgccgccgaaggtaaagtggtgccgaaagtcgccctgcgtccgttagcggacatcaacaccatctttactgagatggaagaaggcaaaatccgtggccgcatggtgattgatttccgtcactaa

SEQ ID NO: 98 - protein, 336 aa, Escherichia coli
MKAAVVTKDHHVDVTYKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSHTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRH

SEQ ID NO: 99 - DNA, 1077 bp, Escherichia coli
atgaaagcactggctcggtttggcaaggcctttggcggctacaagatgattgatgtcccacaacccatgtgtggcccggaagatgtagtgattgaaattaaagccgcggcaatctgcggcgcagacatgaagcactacaatgtcgatagcggttctgatgagtttaactctatccgcggccatgagttcgcaggttgtattgcgcaggttggtgaaaaagtcaaagactggaaagtggggcaacgcgtcgtatcggataacagcggtcacgtttgcggtgtttgtccggcctgtgaacaaggtgattttctgtgttgtacagaaaaagtaaaccttggtctggataataatacctggggcggtggtttttccaaatattgtctggttcctggtgaaattctcaaaattcatcgtcatgcgttgtgggaaatccctgatggtgttgattatgaggacgcagccgtacttgaccctatctgtaatgcctacaaatccatcgcgcagcaatcgaaattccttcctggtcaggatgtggtcgtcatcggcactggcccactcgggctgttctccgtacaaatggcgcgaattatgggggcggtaaatatcgtcgtcgttggtctgcaagaagatgtggcggtccgcttcccggttgcaaaagaactgggtgcgacggcagtagtaaatggttctaccgaagatgtggtggcgcgctgccagcaaatttgtggcaaagacaatctgggactggtgattgaatgctccggtgccaatatcgcactgaaacaagccatcgaaatgctccgcccgaacggggaagtggtacgcgttggaatgggcttcaaacctcttgatttctcgattaatgacattaccgcctggaacaaaagcatcattgggcatatggcctatgactccacctcatggcgtaacgctatcaggctattagccagcggcgctatcaaagtcaaaccgatgatcacgcatcgtatcggcctgtcgcaatggcgcgaagggtttgatgcgatggtcgataaaaccgcaatcaaagtgatcatgacttacgactttgatgaataa

SEQ ID NO: 100 - protein, 358 aa, Escherichia coli
MKALARFGKAFGGYKMIDVPQPMCGPEDVVIEIKAAAICGADMKHYNVDSGSDEFNSIRGHEFAGCIAQVGEKVKDWKVGQRVVSDNSGHVCGVCPACEQGDFLCCTEKVNLGLDNNTWGGGFSKYCLVPGEILKIHRHALWEIPDGVDYEDAAVLDPICNAYKSIAQQSKFLPGQDVVVIGTGPLGLFSVQMARIMGAVNIVVVGLQEDVAVRFPVAKELGATAVVNGSTEDVVARCQQICGKDNLGLVIECSGANIALKQAIEMLRPNGEVVRVGMGFKPLDFSINDITAWNKSIIGHMAYDSTSWRNAIRLLASGAIKVKPMITHRIGLSQWREGFDAMVDKTAIKVIMTYDFDE

SEQ ID NO: 101 - DNA, 1044 bp, Escherichia coli
atgaaaaattcaaaagcaatattgcaggtgccgggcacaatgaaaattatttcagcagaaataccagtgcctaaagaagatgaagttttgattaaagtagaatatgtcggtatttgtggttcagatgtacatggttttgaatcaggcccgtttattccgcctaaagacccaaatcaagaaattggcctgggtcatgaatgcgccgggacggttgtggctgtgggaagccgcgtgcgcaaatttaaaccgggggatcgggtaaatatcgaacctggcgttccttgcggtcactgtcgttactgtctggaaggcaaatataacatctgcccggacgttgattttatggcgacacaacccaactaccgcggcgcattaacgcactatctgtgtcatccggagagctttacttacaaactgcccgacaatatggacacgatggaaggggcgctggtggagcctgccgcagtcgggatgcatgccgcgatgctggcagatgttaaaccgggtaagaagataattattctgggagcaggttgtattggtttgatgacgttgcaagcgtgcaaatgcctgggagcaacggaaattgccgtcgttgatgtgctggaaaaacgtctggcaatggcggaacagcttggtgcgacagtggttattaacggcgcaaaagaagacactattgcacgctgtcagcaatttaccgaagacatgggcgcagatattgttttcgaaacagcgggttctgcggtcaccgttaaacaggcaccttatctggtaatgcgcggcggtaaaattatgattgttggtactgtacccggcgattcggcaatcaatttcctcaaaatcaatcgcgaagtcactatccagacggtattccgctatgccaatcgttatccggtcacgattgaagctatttcttcagggcgattcgatgtgaaatcgatggtgacgcatatttacgattatcgggatgtacaacaggcatttgaagagtcagttaacaacaaacgcgacattattaaaggcgttattaaaattagcgattaa

SEQ ID NO: 102 - protein, 347 aa, Escherichia coli
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 103 - DNA, 1032 bp, Escherichia coli
atgcaagtgaaaacacagtcctgcgttgttgcgggcaagaaaactgttgccgttaccgagcagacgatagattggaataataatggaacattagtacaaataacccgaggtggaatttgcggttccgatttacattattatcaggaaggaaaagtaggtaatttcatgataaaggcaccgatggtgttaggtcatgaagttatcggtaaagttattcatagcgactcatcagaattacatgaagggcaaacggtagccattaatccgtctaaaccgtgcggtcactgcaaatactgcattgaacataacgagaatcagtgtacagatatgcgtttttttggcagtgccatgtatttccctcatgttgatggtggttttacccgttataaaatggtcgaaacgtcgcaatgtgtcccttatccggccaaagctgacgaaaaggttatggcttttgccgaacctttagccgtcgcgattcatgccgcacatcaggccggcgagttacagggcaagcgagtatttatttccggtgttggacccattggctgcctgattgtcagtgcagtgaaaacactgggggccgcggaaattgtctgtgctgatgtgagtccccgttccctttcgctgggcaaagagatgggggcggatgtgctcgtaaacccacaaaacgacgacatggatcactggaaagcggaaaaaggctatttcgatgtcagctttgaagtgtccggtcatccttcatcagtgaatacctgtctggaggtcactcgtgcacgcggcgtaatggtgcaggtaggtatgggaggcgcgatggcagaattcccaatgatgacgttgattggtaaggagatttcactcagaggctctttccgttttaccagcgaatttaataccgcagtgtcatggctggcgaatggcgttatcaatccactgcctttactgagtgctgaatatcccttcactgacctggaagaggcgctacgtttcgccggtgataaaacccaggcagcaaaagtccagcttgttttctaa

SEQ ID NO: 104 - protein, 343 aa, Escherichia coli
MQVKTQSCVVAGKKTVAVTEQTIDWNNNGTLVQITRGGICGSDLHYYQEGKVGNFMIKAPMVLGHEVIGKVIHSDSSELHEGQTVAINPSKPCGHCKYCIEHNENQCTDMRFFGSAMYFPHVDGGFTRYKMVETSQCVPYPAKADEKVMAFAEPLAVAIHAAHQAGELQGKRVFISGVGPIGCLIVSAVKTLGAAEIVCADVSPRSLSLGKEMGADVLVNPQNDDMDHWKAEKGYFDVSFEVSGHPSSVNTCLEVTRARGVMVQVGMGGAMAEFPMMTLIGKEISLRGSFRFTSEFNTAVSWLANGVINPLPLLSAEYPFTDLEEALRFAGDKTQAAKVQLVF

SEQ ID NO: 105 - DNA, 1026 bp, Escherichia coli
atgaaagcgttatccaaactgaaagcggaagagggcatctggatgaccgacgttcctgtaccggaactcgggcataacgatctgctgattaaaatccgtaaaacagccatctgcgggactgacgttcacatctataactgggatgagtggtcgcaaaaaaccatcccggtgccgatggtcgtgggccatgaatatgtcggtgaagtggtaggtattggtcaggaagtgaaaggcttcaagatcggcgatcgcgtttctggcgaaggccatatcacctgtggtcattgccgcaactgtcgtggtggtcgtacccatttgtgccgcaacacgataggcgttggtgttaatcgcccgggctgctttgccgaatatctggtgatcccggcattcaacgccttcaaaatccccgacaatatttccgatgacttagccgcaatttttgatcccttcggtaacgccgtgcataccgcgctgtcgtttgatctggtgggcgaagatgtgctggtttctggtgcaggcccgattggtattatggcagcggcggtggcgaaacacgttggtgcacgcaatgtggtgatcactgatgttaacgaataccgccttgagctggcgcgtaaaatgggtatcacccgtgcggttaacgtcgccaaagaaaatctcaatgacgtgatggcggagttaggcatgaccgaaggttttgatgtcggtctggaaatgtccggtgcgccgccagcgtttcgtaccatgcttgacaccatgaatcacggcggccgtattgcgatgctgggtattccgccgtctgatatgtctatcgactggaccaaagtgatctttaaaggcttgttcattaaaggtatttacggtcgtgagatgtttgaaacctggtacaagatggcggcgctgattcagtctggcctcgatctttcgccgatcattacccatcgtttctctatcgatgatttccagaagggctttgacgctatgcgttcgggccagtccgggaaagttattctgagctgggattaa

SEQ ID NO: 106 - protein, 341 aa, Escherichia coli
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLAAIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 107 - DNA, 1023 bp, Escherichia coli
atgtctacgatgaatgttttaatttgccagcagccgaaagaattagtctggaaacaacgcgagatacctattccgggtgacaatgaagcattaataaaaattaagtctgtcgggatttgcggtaccgatattcatgcctggggtggaaatcaaccattttttagttatccacgtgttttaggccatgaaatatgtggggagattgttgggctgggtaaaaatattgctgatcttaaaaatggtcagcaagttgctgtgatcccttatgttgcctgtcagcaatgcccggcgtgtaaaagcgggcgtaccaattgctgtgaaaaaatttcagtcattggcgtgcatcaggatggcggttttagtgagtatttgagcgtgccggtggcgaacattttgcccgcagacggtattgacccgcaggcggcagcattgattgaacctttcgctattagcgctcatgcggtgcgtcgcgcagccattgctcccggcgagcaggtgctggtggtcggggcggggccaatcggtctgggcgcggcggcaatcgctaaagccgatggcgcacaggtggtggtggcggataccagtccggcgcgccgtgaacatgtggcaacgcgtctggaattacctttactggacccgtcagccgaagattttgacgcgcagctacgggcgcagtttggtggttcgctggcgcagaaagtgatcgacgcgacaggtaatcaacatgcgatgaataacaccgtgaatttgattcgtcacggcggcacggtggtatttgtcggcctgtttaaaggtgagttgcagttctccgatccggaattccataaaaaagaaacgacgatgatgggcagccgcaacgccacgccggaagattttgctaaagtcggtcgactgatggcggaaggaaaaatcactgctgacatgatgttaacccatcgctatccgttcgccacgctggcagaaacctacgagcgcgatgtgattaacaatcgtgagttaattaaaggcgtaattactttctga

SEQ ID NO: 108 - protein, 340 aa, Escherichia coli
MSTMNVLICQQPKELVWKQREIPIPGDNEALIKIKSVGICGTDIHAWGGNQPFFSYPRVLGHEICGEIVGLGKNIADLKNGQQVAVIPYVACQQCPACKSGRTNCCEKISVIGVHQDGGFSEYLSVPVANILPADGIDPQAAALIEPFAISAHAVRRAAIAPGEQVLVVGAGPIGLGAAAIAKADGAQVVVADTSPARREHVATRLELPLLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 109 - DNA, 1020 bp, Escherichia coli
atgaaaagcatattaattgaaaaaccgaatcaactggcgattgtcgaacgtgaaatacccaccccgtcagcgggtgaagtacgagtaaaagtgaaacttgccggaatttgtggttcagatagccatatttatcgtgggcataatccttttgcgaaatatccgcgcgtcattggtcatgaattctttggcgtcattgatgcagtgggtgaaggcgtggaaagcgccagagtcggtgaacgtgttgctgtcgatccggtggtcagctgtgggcattgctatccgtgctctataggtaaaccgaacgtttgtacgacactggctgtattaggtgtgcacgctgacggtggtttcagtgaatatgccgtggttccggcaaaaaatgcgtggaaaattcctgaagcagtggccgatcaatatgcggtaatgatcgaaccttttaccattgcggctaacgtaaccggacatggtcaaccgactgaaaatgataccgttctggtttatggtgccggtccaatcggcctgacgatcgttcaggtattaaaaggcgtctataacgttaaaaatgtgattgttgccgatcgcattgatgaacgactggaaaaagcgaaagagagcggggctgactgggcgattaataacagccagacaccgcttggcgagattttcactgaaaaaggcatcaagccgacattaattatcgatgcggcttgtcatccttctatcctgaaagaggccgtaacgctggcttctccagcggcacgtattgtattgatggggttctccagtgaaccgtctgaagtgattcagcaaggaattaccggaaaagaactctctattttctcttcacgcttaaatgcaaataaattcccgatcgttatcgactggttaagtaaagggttaattaaaccagaaaaattaattacccatacgtttgatttccagcatgttgctgatgccattagtttatttgaacaggatcaaaaacattgctgcaaagtcttactcactttttctgaataa

SEQ ID NO: 110 - protein, 339 aa, Escherichia coli
MKSILIEKPNQLAIVEREIPTPSAGEVRVKVKLAGICGSDSHIYRGHNPFAKYPRVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGEIFTEKGIKPTLIIDAACHPSILKEAVTLASPAARIVLMGFSSEPSEVIQQGITGKELSIFSSRLNANKFPIVIDWLSKGLIKPEKLITHTFDFQHVADAISLFEQDQKHCCKVLLTFSE

SEQ ID NO: 111 - DNA, 1041 bp, Escherichia coli
atgaaatcagtggtgaatgatactgatggtatcgtgcgcgttgcagaaagcgtcattcctgaaattaaacatcaggatgaggtgcgggtaaaaattgccagctcgggcttatgtggttccgatttacccaggatatttaaaaatggtgcacattattatccaataacgttaggccatgaatttagcggctatattgatgcggtgggatccggtgttgatgatttacaccctggcgatgcggttgcctgtgtgccgttattaccctgttttacttgtccagagtgtctgaaagggttttattcccagtgcgcaaaatatgattttattggctcgcggcgtgatggtggatttgctgaatatattgtcgttaagcgaaaaaatgtctttgctctacccacggatatgcctattgaggatggggcttttattgagccgattaccgttggtctgcatgcttttcatttagcgcaaggttgtgagaataaaaacgttattattattggtgccggaaccattggcctgctggccattcagtgcgctgtcgcgctgggagcaaagagtgtgacggcgatcgacattagttcagaaaaactggcactggcaaaatctttcggtgcgatgcaaacatttaacagtagcgaaatgagcgcgccgcaaatgcagagcgttttacgcgaactgcgctttaatcagcttatcctcgagacggctggcgtaccgcaaactgtcgaactggcggtagagattgccggtcctcatgcccaactggcgctggtgggcacgttgcatcaggatctgcatttaacatcggcaacgtttggcaaaatattgcgtaaagagctgacggttatcggcagttggatgaactactccagcccttggccggggcaggagtgggaaacggcgagccggttgctgacagaacgtaagttaagcctggagccattaatcgctcaccgtggaagctttgaaagcttcgcccaggcggtgcgtgacatcgctcgtaatgctatgccgggcaaagtgttgctcattccctga

SEQ ID NO: 112 - protein, 346 aa, Escherichia coli
MKSVVNDTDGIVRVAESVIPEIKHQDEVRVKIASSGLCGSDLPRIFKNGAHYYPITLGHEFSGYIDAVGSGVDDLHPGDAVACVPLLPCFTCPECLKGFYSQCAKYDFIGSRRDGGFAEYIVVKRKNVFALPTDMPIEDGAFIEPITVGLHAFHLAQGCENKNVIIIGAGTIGLLAIQCAVALGAKSVTAIDISSEKLALAKSFGAMQTFNSSEMSAPQMQSVLRELRFNQLILETAGVPQTVELAVEIAGPHAQLALVGTLHQDLHLTSATFGKILRKELTVIGSWMNYSSPWPGQEWETASRLLTERKLSLEPLIAHRGSFESFAQAVRDIARNAMPGKVLLIP

SEQ ID NO: 113 - DNA, 1062 bp, Escherichia coli
atgaaaacgatgctggcagcttatttaccaggaaattcgaccgtcgatctgcgggaagttgcggtgccgacgccggggattaaccaggtactgatcaaaatgaaatcctccgggatttgcggaagcgatgtccactatatctatcatcaacaccgtgccacagcggcggcacccgataaaccgttataccagggctttatcaacggtcatgaaccgtgcgggcagattgtggcgatggggcaaggctgccgccattttaaagagggcgaccgcgtgctggtgtatcacatttctggctgtggtttttgcccgaactgccgtcgcggttttcctatttcttgtactggcgaaggaaaagcggcttacggctggcagcgtgacggcggtcatgccgaatacttgctggcggaagaaaaagatctgatcctcctgccggatgcgctgagctacgaagatggtgcgtttatcagttgcggcgttggtacagcgtatgaaggaattttgcgcggcgaagtttccggcagtgataacgtgctggtggtcggtctggggccagtcggcatgatggcgatgatgctggcgaaaggtcgcggtgcaaaacggatcatcggcgttgatatgctgccggaacgtctggcgatggcaaaacagttaggggtgatggatcacggctatttagcaaccaccgaaggtctgccgcagattatcgccgaactcacccacggtggcgcggatgttgcgctcgattgttccggtaatgccgcaggtcgcttgctggcactgcaatccaccgctgactggggacgggtggtttacattggtgaaaccggaaaagtggaattcgaggtcagcgccgatctgatgcaccatcaacggcggattatcggctcctgggtgaccagtctgttccatatggaaaaatgcgcccatgatctgacggactggaagctgtggccgcgtaacgccattacccatcgcttctcgctggaacaggcaggtgatgcctatgcgctgatggcgagcggcaaatgcgggaaagttgtgattaacttcccggattaa

SEQ ID NO: 114 - protein, 353 aa, Escherichia coli
MKTMLAAYLPGNSTVDLREVAVPTPGINQVLIKMKSSGICGSDVHYIYHQHRATAAAPDKPLYQGFINGHEPCGQIVAMGQGCRHFKEGDRVLVYHISGCGFCPNCRRGFPISCTGEGKAAYGWQRDGGHAEYLLAEEKDLILLPDALSYEDGAFISCGVGTAYEGILRGEVSGSDNVLVVGLGPVGMMAMMLAKGRGAKRIIGVDMLPERLAMAKQLGVMDHGYLATTEGLPQIIAELTHGGADVALDCSGNAAGRLLALQSTADWGRVVYIGETGKVEFEVSADLMHHQRRIIGSWVTSLFHMEKCAHDLTDWKLWPRNAITHRFSLEQAGDAYALMASGKCGKVVINFPD

SEQ ID NO: 115 - DNA, 975 bp, Escherichia coli
atgcaggcgttacttttagaacagcaggacggcaaaactctcgcatcagtacagactctggacgaaagtcgcctgccggagggcgatgtcacggtcgatgttcactggtcgagcctgaactataaagatgcgctggcgattaccggtaagggaaaaatcatccgtaattttccgatgattcctgggatcgattttgccggaactgtacgcaccagcgaagatccgcgttttcatgccggtcaggaggtgttactcactggctggggcgttggtgaaaaccactggggtgggctggcggagcaggcgcgagtgaaaggtgactggctggttgccatgccgcaagggctggacgcgcgtaaagcaatgattatcggtactgccggttttaccgccatgctgtgtgtgatggcgctggaagatgccggtgttcgcccgcaggacggggagattgtcgtgacgggtgccagtggtggcgtcggcagtaccgccgtggcgctgctgcataagttgggttatcaggtcgttgccgtttccggtcgcgaaagtacccatgaatatctgaaaagtttaggtgctagccgtgttctccctcgtgatgagtttgccgaatcccgtcctctggaaaaacaagtctgggctggggcaattgacaccgttggcgacaaagtgctggcaaaagtgctggcgcaaatgaattacggcggctgcgtggcggcctgtggtctggcgggtggttttactctgccaaccacggtcatgccatttattctgcgtaatgtccgtttgcaaggggtggattcagtaatgacgccaccagaacgccgcgcacaagcctggcagcgactggtcgccgatttaccggaatcattctatacccaggcggcaaaagagatatctctgtcagaggcaccgaactttgccgaggccatcattaataaccagatccagggtcgcacgctggtgaaggttaactaa

SEQ ID NO: 116 - protein, 324 aa, Escherichia coli
MQALLLEQQDGKTLASVQTLDESRLPEGDVTVDVHWSSLNYKDALAITGKGKIIRNFPMIPGIDFAGTVRTSEDPRFHAGQEVLLTGWGVGENHWGGLAEQARVKGDWLVAMPQGLDARKAMIIGTAGFTAMLCVMALEDAGVRPQDGEIVVTGASGGVGSTAVALLHKLGYQVVAVSGRESTHEYLKSLGASRVLPRDEFAESRPLEKQVWAGAIDTVGDKVLAKVLAQMNYGGCVAACGLAGGFTLPTTVMPFILRNVRLQGVDSVMTPPERRAQAWQRLVADLPESFYTQAAKEISLSEAPNFAEAIINNQIQGRTLVKVN

SEQ ID NO: 117 - DNA, 1053 bp, Escherichia coli
atgaaaaagttagtagccacagcaccgcgtgttgctgcgctggttgagtatgaagatcgggcgattttagctaatgaagtgaagatccgcgtgcgtttcggcgcaccgaaacacggaacggaagtggtcgacttccgcgccgccagcccgtttattgatgaagactttaacggcgaatggcagatgttcactccgcgtccggcagatgcgccgcgcggcattgagtttggcaaattccagcttggcaacatggtggttggcgacattatcgagtgcggcagcgacgttaccgactacgcggtgggcgacagcgtatgcggctacggcccgctctccgagacggtcatcattaacgcagtgaataactacaagctgcgcaaaatgccgcaaggcagctcctggaaaaacgccgtctgctacgacccggcgcagtttgccatgagcggcgtgcgcgatgccaacgtgcgcgtaggggattttgtggtggtggtagggcttggcgcaatcggtcaaattgccatccaactggctaaacgcgctggcgcttctgtggtgattggcgtcgatcctatcgcccatcgctgtgatattgcccgtcgccacggcgcggatttctgccttaaccccatcggcactgatgtaggtaaagagatcaaaacgctgaccggcaagcagggtgccgatgtgattatcgaaaccagcggctacgccgacgcgctgcaatcggcgctccgcggtctggcttatggcggcaccatctcctatgtcgcgtttgccaagccgtttgccgaaggttttaacctcggacgcgaagcgcatttcaataacgccaaaattgtcttctctcgcgcgtgcagcgaaccgaacccggattatccgcgctggagccgcaagcgtattgaagaaacctgttgggaactgctgatgaacggttatctcaattgcgaagatttaatcgacccggtggtgacctttgccaatagcccggaaagctatatgcagtatgtcgaccagcatccggaacagagcatcaaaatgggcgttacgttttaa

SEQ ID NO: 118 - protein, 350 aa, Escherichia coli
MKKLVATAPRVAALVEYEDRAILANEVKIRVRFGAPKHGTEVVDFRAASPFIDEDFNGEWQMFTPRPADAPRGIEFGKFQLGNMVVGDIIECGSDVTDYAVGDSVCGYGPLSETVIINAVNNYKLRKMPQGSSWKNAVCYDPAQFAMSGVRDANVRVGDFVVVVGLGAIGQIAIQLAKRAGASVVIGVDPIAHRCDIARRHGADFCLNPIGTDVGKEIKTLTGKQGADVIIETSGYADALQSALRGLAYGGTISYVAFAKPFAEGFNLGREAHFNNAKIVFSRACSEPNPDYPRWSRKRIEETCWELLMNGYLNCEDLIDPVVTFANSPESYMQYVDQHPEQSIKMGVTF

SEQ ID NO: 119 - DNA, 1038 bp, Escherichia coli
atggggcaacaaaagcagcgtaatcgacgttgggttctggcctcgcgtccacatggcgcacctgttccggagaatttccgtcttgaagaagatgatgtcgccacaccgggtgaaggacaggtgttactgcgcacagtttatttgtccctggacccgtatatgcgtggacgtatgagcgatgagccatcttattcaccgcctgttgatattggcggcgtgatggtcggcggtacggtgagccgtgtcgtggagtcgaatcatcctgattatcagtctggcgactgggtgctgggctacagtggatggcaagactatgacatatccagtggtgatgatctggtgaaacttggcgatcatccgcaaaatccatcgtggtcgctgggtgtgctagggatgccaggctttaccgcttatatgggcctactggatatcggtcagcctaaagagggcgaaacgttggtggtagctgcggcgacaggaccagtgggggcgacggtggggcaaatcggcaaacttaaaggttgcagagtggtgggggtagccggtggcgcggaaaaatgccgccatgctaccgaggtgttaggcttcgatgtttgtcttgatcaccacgcggatgattttgccgaacaactggcgaaagcgtgcccaaaaggtattgatatctattatgaaaacgtgggcggtaaggtattcgatgcggtgctaccgttacttaatacatctgcgcgcattcccgtctgcggattagtgagcagctataacgctacagagctaccacccggtccggatcgtttacctctgttgatggctacagtgctgaaaaaacgtattcgcttgcaaggttttattatcgctcaggattatggtcaccgcatccatgagtttcagagggagatggggcaatgggtgaaagaggataaaatccactaccgcgaagaaattactgacggtttagagaatgcgccacagacgtttatcggcctgctgaagggtaaaaacttcggcaaagtggtgatccgcgtggcgggtgatgattaa

SEQ ID NO: 120 - protein, 345 aa, Escherichia coli
MGQQKQRNRRWVLASRPHGAPVPENFRLEEDDVATPGEGQVLLRTVYLSLDPYMRGRMSDEPSYSPPVDIGGVMVGGTVSRVVESNHPDYQSGDWVLGYSGWQDYDISSGDDLVKLGDHPQNPSWSLGVLGMPGFTAYMGLLDIGQPKEGETLVVAAATGPVGATVGQIGKLKGCRVVGVAGGAEKCRHATEVLGFDVCLDHHADDFAEQLAKACPKGIDIYYENVGGKVFDAVLPLLNTSARIPVCGLVSSYNATELPPGPDRLPLLMATVLKKRIRLQGFIIAQDYGHRIHEFQREMGQWVKEDKIHYREEITDGLENAPQTFIGLLKGKNFGKVVIRVAGDD

SEQ ID NO: 121 - DNA, 984 bp, Escherichia coli
atggcaacacgaattgaatttcacaagcacggtggcccggaagtacttcaagccgtagagttcactcctgccgatccggcggagaatgaaatccaggtcgaaaataaagccatcggcatcaattttatcgacacatatatccgcagcggcctttacccgccgccatcgctacccagcggattaggcaccgaagcagcaggcatcgtgagtaaagtcggcagtggtgtaaagcatattaaggcaggcgatcgtgtagtctatgcgcagtcggcgttaggcgcttacagctctgtgcataacattattgcggataaagcggcgattctgcctgcggcaatttcttttgagcaagctgcggcatccttcctgaaaggcttaacggtttattatctgctgcgcaaaacctatgaaattaaacccgatgaacagttcctgttccacgcagcggctggcggcgttggcttaattgcctgccagtgggcaaaagccctgggcgcgaaacttatcggcaccgtaggaaccgcgcaaaaagcgcagagcgcgctaaaagcgggcgcgtggcaggttattaactatcgtgaagaggatctggtcgagcggttaaaagagatcaccggcggtaagaaagtgcgcgtggtgtacgattccgtgggcagagacacctgggaacggtcgctggattgcctgcaacgccgcggcttaatggtcagttttggcaactcatcaggtgcggttaccggtgtgaacttaggcattctcaatcaaaaaggctcgttgtatgtgacacgcccttccctgcaaggctatatcaccacgcgggaggaattaaccgaggccagtaatgaactgttctctttgattgccagcggtgtgattaaggtcgatgtcgccgagcagcagaaatatccgctgaaggatgcgcagcgtgcgcatgagattctggaaagccgggcgacgcaaggttccagcctgctgattccataa

SEQ ID NO: 122 - protein, 327 aa, Escherichia coli
MATRIEFHKHGGPEVLQAVEFTPADPAENEIQVENKAIGINFIDTYIRSGLYPPPSLPSGLGTEAAGIVSKVGSGVKHIKAGDRVVYAQSALGAYSSVHNIIADKAAILPAAISFEQAAASFLKGLTVYYLLRKTYEIKPDEQFLFHAAAGGVGLIACQWAKALGAKLIGTVGTAQKAQSALKAGAWQVINYREEDLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDAQRAHEILESRATQGSSLLIP

SEQ ID NO: 123 - DNA, 1110 bp, Escherichia coli
tcagtaacgaattacggttcgaatggatttgccttcatgcatcaggtcgaaggcgtcattaatttcatccaggctcatggtatgcgtgacaaacggttccagatcgatatcacctttcatcgcatcttcaaccatgcccggtaactgggaacgacctttcacgccgccaaacgcggaacctttccatacgcgaccagtgaccaactggaatggacgggtggagatttcctgaccggcaaccgcgaccccgatgatcaccgactgaccccagccgcggtgcgcactttccagcgccgcacgcatcacgttgacgttaccgatgcattcaaaggtatggtcgataccccatttgttgatatccaacaggacatcttttatcggtttgtcgtagtcattcgggttaatgcagtcggtagcaccgaagcgacgcgccagatcgaatttcttcgggttggtatcgatagcgataatccgacccgctttcgcctgacgcgcgccctgaaccactgccagaccaatcgcgccaagaccaaacacggcaacagaatcacctggctggactttagctgtgttgtgtaccgcgccaataccggtggtcacgccacagcccagcaggcagacgtgttcatggtttgcttctggattaatttttgccagagacacttccgcgactacggtgtattcactgaatgtagagcaccccatgtagtgataaagcggctgcccgttgtaagaaaaacgggtggtgccgtctggcatcaggcctttaccctgggtttcgcgaaccgcaacacagaggttagttttgccagaacgacagaactcacactcgccgcactccgcggtgtaaagcgggatcacatggtcgccaggtttgacgctggttacgccttcaccgacttcaaccacaacgccggccccttcgtgaccgagaaccaccgggaatacaccttccgggtcatcgccggagagggtaaatgcgtcggtatggcaaacgccggtatgggtgactttaattagcacttcaccttttttcggtggtgcaacgtcaatttcaacgatttccagcggtttaccgggagcaaatgcaacggcagcacgtgatttcat

SEQ ID NO: 124 - protein, 369 aa, Escherichia coli
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 125 - DNA, 1239 bp, Escherichia coli
atgaaagcattgacttatcacggcccacatcacgttcaggtagaaaatgttcccgatccgggcgttgaacaggcagatgatattattctgcgtattacggcaacggcgatctgtggctctgacctccatctttatcgaggcaaaatacctcaggttaaacatggcgatatttttggtcatgaatttatgggggaagtagttgaaaccggaaaggacgtaaaaaatttgcaaaaaggcgaccgagtggtaattccgttcgtcattgcttgtggcgactgttttttctgtcgattgcaacaatatgccgcctgcgaaaataccaatgcgggtaaaggcgctgcgctcaataaaaaacagataccagctccagcggcattgtttggttatagtcacctgtatggcggcgttcctggtgggcaggcggaatatgtccgcgtccctaaagggaatgtggggccgtttaaagtaccgcctttgctttcagatgataaagcgcttttcctttctgatattctgccaacggcatggcaggcagcaaaaaatgcgcagatccaacaaggttcaagcgttgcagtctatggtgctggtcctgtgggattgttgacaatcgcctgtgcacggttgctcggtgcggaacagatttttgttgttgatcatcatccctaccgcttgcatttcgccgccgaccgctacggcgcgatcccgattaattttgatgaagacagcgatccggcacagtcaattattgaacaaacggcaggtcaccggggcgtggatgcagtaatagacgccgtcggttttgaagcgaaaggcagcaccacggaaacggtgctgactaacctgaaactggagggcagcagcggtaaagcgttgcgtcagtgtattgcggcggtcaggcgtggcggcattgttagcgtaccgggcgtctacgctggatttattcacggtttcctgtttggcgacgcctttgataaagggttgtcgtttaaaatgggacagacccacgttcacgcatggctgggagaattattaccgttaattgagaaaggattactgaaaccagaagaaattgttacccactatatgccgtttgaagaggccgcccggggatatgagattttcgaaaaacgtgaagaggagtgccgtaaggtgattctggtacccggtgcacaaagcgcagaggcggcgcagaaggcggtttcaggtctggtgaatgcgatgccggggggaacaatatga

SEQ ID NO: 126 - protein, 412 aa, Escherichia coli
MKALTYHGPHHVQVENVPDPGVEQADDIILRITATAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNAQIQQGSSVAVYGAGPVGLLTIACARLLGAEQIFVVDHHPYRLHFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLSFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 127 - DNA, 1278 bp, Escherichia coli
atgaaaaccaaagttgctgctatttatggcaagcgggatgtccgtctgcgcgtatttgaactgccagaaattaccgataatgaattactggtgagtgtaatttctgacagcgtctgtttatcgacctggaaagcggcgttactcggtagtgaacataaacgcgtacccgacgatttagaaaatcatccggtcattaccgggcatgaatgtgccggggttattgtcgaagtgggtaaaaatctcactggcaaatataaaaaaggccagcgttttgtattgcaaccggcgatggggttaccaagcggatattcagcgggctacagctacgaatattttggcggcaatgccacttatatgattattcccgaaatcgccattaatttgggctgcgtattaccgtatcacggctcttattttgctgcggcgtcgctggcagagcctatgtgctgcattattggtgcttatcatgccaattatcacaccacgcaatatgtttatgagcatcgcatgggcgtcaaacctggcggcaatattgcactgctggcgtgtgcaggtccgatgggcattggcgctatcgattacgccattaacggcggcatacaaccgtcgcgggtggtggtggtcgatatcgacgacaaacgtctggcgcaggtacagaagctgctgccggtggaactggcggccagtaaaggcattgagctggtgtatgtgaataccaaagggatgagcgatcctgtccagatgctgcgggcgctgacaggagatgccgggttcgatgacatttttgtttatgcggcggtgcctgctgtcgttgagatggctgatgaattactggcggaagatggctgtctgaacttctttgccgggccgacggataaaaacttcaaagtgccgtttaatttctacaacgtccattacaacagcacgcacgtcgtcggtacatctggcggttcaacggacgacatgaaagaggcgattgcccttagcgccactgggcagttacagccgtcgtttatggtgacccatatcggtggcctggatgcggtgccagaaaccgtgctcaatctgccggatatccctggcggtaaaaaactcatttataacggcgtgaccatgccgctcactgccattgccgattttgccgaaaaaggcaaaaccgatccgctgtttaaagagttggcgcggctggttgaggaaacgcacggcatctggaatgaacaggccgagaaatatctgctggcacaatttggcgttgatatcggggaggccgcgcaatga

SEQ ID NO: 128 - protein, 425 aa, Escherichia coli
MKTKVAAIYGKRDVRLRVFELPEITDNELLVSVISDSVCLSTWKAALLGSEHKRVPDDLENHPVITGHECAGVIVEVGKNLTGKYKKGQRFVLQPAMGLPSGYSAGYSYEYFGGNATYMIIPEIAINLGCVLPYHGSYFAAASLAEPMCCIIGAYHANYHTTQYVYEHRMGVKPGGNIALLACAGPMGIGAIDYAINGGIQPSRVVVVDIDDKRLAQVQKLLPVELAASKGIELVYVNTKGMSDPVQMLRALTGDAGFDDIFVYAAVPAVVEMADELLAEDGCLNFFAGPTDKNFKVPFNFYNVHYNSTHVVGTSGGSTDDMKEAIALSATGQLQPSFMVTHIGGLDAVPETVLNLPDIPGGKKLIYNGVTMPLTAIADFAEKGKTDPLFKELARLVEETHGIWNEQAEKYLLAQFGVDIGEAAQ

SEQ ID NO: 129 - DNA, 1152 bp, Escherichia coli
atggcagcttcaacgttctttattccttctgtgaatgtcatcggcgctgattcattgactgatgcaatgaatatgatggcagattatggatttacccgtaccttaattgtcactgacaatatgttaacgaaattaggtatggcgggcgatgtgcaaaaagcactggaagaacgcaatatttttagcgttatttatgatggcacccaacctaaccccaccacggaaaacgtcgccgcaggtttgaaattacttaaagagaataattgcgatagcgtgatctccttaggcggtggttctccacacgactgcgcaaaaggtattgcgctggtggcagccaatggcggcgatattcgcgattacgaaggcgttgaccgctctgcaaaaccgcagctgccgatgatcgccatcaataccacggcgggtacggcctctgaaatgacccgtttctgcatcatcactgacgaagcgcgtcatatcaaaatggcgattgttgataaacatgtcactccgctgctttctgtcaatgactcctctctgatgattggtatgccgaagtcactgaccgccgcaacgggtatggatgccttaacgcacgctatcgaagcatatgtttctattgccgccacgccgatcactgacgcttgtgcactgaaagccgtgaccatgattgccgaaaacctgccgttagccgttgaagatggcagtaatgcgaaagcgcgtgaagcaatggcttatgcccagttcctcgccggtatggcgttcaataatgcttctctgggttatgttcatgcgatggcgcaccagctgggcggtttctacaacctgccacacggtgtatgtaacgccgttttgctgccgcacgttcaggtattcaacagcaaagtcgccgctgcacgtctgcgtgactgtgccgctgcaatgggcgtgaacgtgacaggtaaaaacgacgcggaaggtgctgaagcctgcattaacgccatccgtgaactggcgaagaaagtggatatcccggcaggcctacgcgacctgaacgtgaaagaagaagatttcgcggtattggcgactaatgccctgaaagatgcctgtggctttactaacccgatccaggcaactcacgaagaaattgtggcgatttatcgcgcagcgatgtaa

SEQ ID NO: 130 - protein, 383 aa, Escherichia coli
MAASTFFIPSVNVIGADSLTDAMNMMADYGFTRTLIVTDNMLTKLGMAGDVQKALEERNIFSVIYDGTQPNPTTENVAAGLKLLKENNCDSVISLGGGSPHDCAKGIALVAANGGDIRDYEGVDRSAKPQLPMIAINTTAGTASEMTRFCIITDEARHIKMAIVDKHVTPLLSVNDSSLMIGMPKSLTAATGMDALTHAIEAYVSIAATPITDACALKAVTMIAENLPLAVEDGSNAKAREAMAYAQFLAGMAFNNASLGYVHAMAHQLGGFYNLPHGVCNAVLLPHVQVFNSKVAAARLRDCAAAMGVNVTGKNDAEGAEACINAIRELAKKVDIPAGLRDLNVKEEDFAVLATNALKDACGFTNPIQATHEEIVAIYRAAM

SEQ ID NO: 131 - DNA, 1152 bp, Escherichia coli
atgatggctaacagaatgattctgaacgaaacggcatggtttggtcggggtgctgttggggctttaaccgatgaggtgaaacgccgtggttatcagaaggcgctgatcgtcaccgataaaacgctggtgcaatgcggcgtggtggcgaaagtgaccgataagatggatgctgcagggctggcatgggcgatttacgacggcgtagtgcccaacccaacaattactgtcgtcaaagaagggctcggtgtattccagaatagcggcgcggattacctgatcgctattggtggtggttctccacaggatacttgtaaagcgattggcattatcagcaacaacccggagtttgccgatgtgcgtagcctggaagggctttccccgaccaataaacccagtgtaccgattctggcaattcctaccacagcaggtactgcggcagaagtgaccattaactacgtgatcactgacgaagagaaacggcgcaagtttgtttgcgttgatccgcatgatatcccgcaggtggcgtttattgacgctgacatgatggatggtatgcctccagcgctgaaagctgcgacgggtgtcgatgcgctcactcatgctattgaggggtatattacccgtggcgcgtgggcgctaaccgatgcactgcacattaaagcgattgaaatcattgctggggcgctgcgaggatcggttgctggtgataaggatgccggagaagaaatggcgctcgggcagtatgttgcgggtatgggcttctcgaatgttgggttagggttggtgcatggtatggcgcatccactgggcgcgttttataacactccacacggtgttgcgaacgccatcctgttaccgcatgtcatgcgttataacgctgactttaccggtgagaagtaccgcgatatcgcgcgcgttatgggcgtgaaagtggaaggtatgagcctggaagaggcgcgtaatgccgctgttgaagcggtgtttgctctcaaccgtgatgtcggtattccgccacatttgcgtgatgttggtgtacgcaaggaagacattccggcactggcgcaggcggcactggatgatgtttgtaccggtggcaacccgcgtgaagcaacgcttgaggatattgtagagctttaccataccgcctggtaa

SEQ ID NO: 132 - protein, 383 aa, Escherichia coli
MMANRMILNETAWFGRGAVGALTDEVKRRGYQKALIVTDKTLVQCGVVAKVTDKMDAAGLAWAIYDGVVPNPTITVVKEGLGVFQNSGADYLIAIGGGSPQDTCKAIGIISNNPEFADVRSLEGLSPTNKPSVPILAIPTTAGTAAEVTINYVITDEEKRRKFVCVDPHDIPQVAFIDADMMDGMPPALKAATGVDALTHAIEGYITRGAWALTDALHIKAIEIIAGALRGSVAGDKDAGEEMALGQYVAGMGFSNVGLGLVHGMAHPLGAFYNTPHGVANAILLPHVMRYNADFTGEKYRDIARVMGVKVEGMSLEEARNAAVEAVFALNRDVGIPPHLRDVGVRKEDIPALAQAALDDVCTGGNPREATLEDIVELYHTAW

SEQ ID NO: 133 - DNA, 1188 bp, Escherichia coli
atgcaaaatgaattgcagaccgcgctctttcaggcgttcgataccctgaatctgcaacgggtaaaaacatttagcgttccaccggtgacgctttgcggtccgggctcggtgagcagttgcggacagcaagcgcaaacgcgtgggctgaaacatctgttcgtgatggcagacagctttttgcatcaggcagggatgaccgccgggctgacgcgtagcctgaccgttaaaggtatcgccatgacgctctggccatgtccggtgggcgaaccgtgcattaccgacgtgtgtgcagccgtggcgcagttgcgtgagtcaggctgtgatggggtgatcgcgtttggcggcggctcggtgctggatgcggcgaaagccgtgacgttgctggtgacgaacccggatagcacgctggcagagatgtcagaaaccagcgttctgcaaccgcgcttgccgctgattgccattccaactaccgccggaaccggctctgaaaccaccaatgtaacggtgattatcgacgcggtgagcgggcgcaagcaggtgttagcccatgcctcgctgatgccggatgtggcgatcctcgacgccgcattgaccgaaggtgtgccgtcgcatgtcacggcgatgaccggcattgatgcgttaacccatgccattgaagcatacagcgccctgaacgctacaccgtttaccgacagtctggcgattggtgccattgcgatgattggcaaatcgctgccgaaagcggtgggctacggtcacgaccttgccgcgcgcgagagcatgttgctggcttcatgtatggcgggaatggcgttttccagtgcgggtcttgggttgtgccacgcgatggcgcatcagccgggcgcggcgctgcatattccgcacggtctcgcgaacgccatgttgctgccaacggtgatggaatttaaccggatggtttgtcgtgaacgctttagtcagattggtcgggcactgcgaactaaaaaatccgacgatcgtgacgctattaacgcggtaagtgagctgattgcggaagttgggattggtaaacgactgggcgatgttggtgcgacatctgcgcattacggcgcatgggcgcaggccgcgctggaagatatttgtctgcgcagtaacccgcgtaccgccagcctggagcagattgtcggcctgtacgcagcggcgcaataa

SEQ ID NO: 134 - protein, 395 aa, Escherichia coli
MQNELQTALFQAFDTLNLQRVKTFSVPPVTLCGPGSVSSCGQQAQTRGLKHLFVMADSFLHQAGMTAGLTRSLTVKGIAMTLWPCPVGEPCITDVCAAVAQLRESGCDGVIAFGGGSVLDAAKAVTLLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRERFSQIGRALRTKKSDDRDAINAVSELIAEVGIGKRLGDVGATSAHYGAWAQAALEDICLRSNPRTASLEQIVGLYAAAQ

SEQ ID NO: 135 - DNA, 1164 bp, Escherichia coli
atgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgttggatgtcagccgccgtatatacgaagccgcccgctaa

SEQ ID NO: 136 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 137 - DNA, 2676 bp, Escherichia coli
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagtctgaagacccgtaacgccattatcttctccccgcacccgcgtgcaaaagatgccaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggcaacactccagttgttatcgatgaaactgctgatatcaaacgtgcagttgcatctgtactgatgtccaaaaccttcgacaacggcgtaatctgtgcttctgaacagtctgttgttgttgttgactctgtttatgacgctgtacgtgaacgttttgcaacccacggcggctatctgttgcagggtaaagagctgaaagctgttcaggatgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggcgcgtatcctgattaacaccccagcgtctcagggtggtatcggtgacctgtataacttcaaactcgcaccttccctgactctgggttgtggttcttggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaagagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatatccgctggcagactatgcgctgactccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacttgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaaggtgaaactgcagcgaagaaagaagctgctccggctaaagctgagaaaaaagcgaaaaaatccgcttaa

SEQ ID NO: 138 - protein, 891 aa, Escherichia coli
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 139 - DNA, 804 bp, Escherichia coli
atggctatccctgcatttggtttaggtactttccgtctgaaagacgacgttgttatttcatctgtgataacggcgcttgaacttggttatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccaagtctgaaagagagcctgcaaaaattgcgtaccgattatgttgatctgacgctaatccactggccgtcaccaaacgatgaagtctctgttgaagagtttatgcaggcgctgctggaagccaaaaaacaagggctgacgcgtgagatcggtatttccaacttcacgatcccgttgatggaaaaagcgattgctgctgttggtgctgaaaacatcgctactaaccagattgaactctctccttatctgcaaaaccgtaaagtggttgcctgggctaaacagcacggcatccatattacttcctatatgacgctggcgtatggtaaggccctgaaagatgaggttattgctcgtatcgcagctaaacacaatgcgactccggcacaagtgattctggcgtgggctatgggggaaggttactcagtaattccttcttctactaaacgtaaaaacctggaaagtaatcttaaggcacaaaatttacagcttgatgccgaagataaaaaagcgatcgccgcactggattgcaacgaccgcctggttagcccggaaggtctggctcctgaatgggattaa

SEQ ID NO: 140 - protein, 267 aa, Escherichia coli
MAIPAFGLGTFRLKDDVVISSVITALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIARIAAKHNATPAQVILAWAMGEGYSVIPSSTKRKNLESNLKAQNLQLDAEDKKAIAALDCNDRLVSPEGLAPEWD

SEQ ID NO: 141 - DNA, 981 bp, Escherichia coli
atgaaaaagatacctttaggcacaacggatattacgctttcgcgaatggggttggggacatgggccattggcggcggtcctgcatggaatggcgatctcgatcggcaaatatgtattgatacgattcttgaagcccatcgttgtggcattaatctgattgatactgcgccaggatataactttggcaatagtgaagttatcgtcggtcaggcgttaaaaaaactgccccgtgaacaggttgtagtagaaaccaaatgcggcattgtctgggaacgaaaaggaagtttattcaacaaagttggcgatcggcagttgtataaaaacctttccccggaatctatccgcgaagaggtagcagcgagcttgcaacgtctgggtattgattacatcgatatctacatgacgcactggcagtcggtgccgccattttttacgccgatcgctgaaactgtcgcagtgcttaatgagttaaagtctgaagggaaaattcgcgctataggcgctgctaacgtcgatgctgaccatatccgcgagtatctgcaatatggtgaactggatattattcaggcgaaatacagtatcctcgaccgggcaatggaaaacgaactgctgccactatgtcgtgataatggcattgtggttcaggtttattccccgctagagcagggattgttgaccggcaccatcactcgtgattacgttccgggcggcgctcgggcaaataaagtctggttccagcgtgaaaacatgctgaaagtgattgatatgcttgaacagtggcagccactttgtgctcgttatcagtgcacaattcccactctggcactggcgtggatattaaaacagagtgatttaatctccattcttagtggggctactgcaccggaacaggtacgcgaaaatgtcgcggcactgaatatcaacttatcggatgcagacgcaacattgatgagggaaatggcagaggccctggagcgttaa

SEQ ID NO: 142 - protein, 326 aa, Escherichia coli
MKKIPLGTTDITLSRMGLGTWAIGGGPAWNGDLDRQICIDTILEAHRCGINLIDTAPGYNFGNSEVIVGQALKKLPREQVVVETKCGIVWERKGSLFNKVGDRQLYKNLSPESIREEVAASLQRLGIDYIDIYMTHWQSVPPFFTPIAETVAVLNELKSEGKIRAIGAANVDADHIREYLQYGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEALER

SEQ ID NO: 143 - DNA, 855 bp, Escherichia coli
atgcaacaaaaaatgattcaatttagtggcgatgtctcactgccagccgtagggcagggaacatggtatatgggcgaagatgccagtcagcgcaaaacagaagttgctgcactacgcgcgggcattgaactcggtttaaccctcattgataccgccgaaatgtatgccgatggcggtgccgaaaaggtggttggggaagcattaaccggtctgcgagagaaggtctttctcgtctctaaagtctatccgtggaatgctggcgggcaaaaagcgataaatgcatgcgaagccagtttacgccgtctcaatactgattatctcgatctttacttattacactggtctggcagtttcgcttttgaagagactgtcgcagcgatggaaaaattgatcgcccagggaaaaatccgccgctggggcgtttctaaccttgattatgctgatatgcaggaactctggcagctgccggggggaaatcagtgtgccactaatcaggtgctttaccatctcggttcacgaggaattgagtacgatctactcccctggtgccagcaacagcagatgccggtgatggcttacagtccgttagcccaggccgggcggttgcgcaatggactgttaaaaaacgcggtagtcaacgaaattgcacatgctcacaatatcagcgcggcacaagtattgttggcgtgggtgatcagtcatcagggtgtgatggcgattccaaaagcggccacgattgcccatgtccaacaaaatgcggctgtgcttgaggtcgaactttcttcagcggaattagctatgctggataaggcatatccggcaccaaaaggaaaaactgcgctggatatggtgtga

SEQ ID NO: 144 - protein, 284 aa, Escherichia coli
MQQKMIQFSGDVSLPAVGQGTWYMGEDASQRKTEVAALRAGIELGLTLIDTAEMYADGGAEKVVGEALTGLREKVFLVSKVYPWNAGGQKAINACEASLRRLNTDYLDLYLLHWSGSFAFEETVAAMEKLIAQGKIRRWGVSNLDYADMQELWQLPGGNQCATNQVLYHLGSRGIEYDLLPWCQQQQMPVMAYSPLAQAGRLRNGLLKNAVVNEIAHAHNISAAQVLLAWVISHQGVMAIPKAATIAHVQQNAAVLEVELSSAELAMLDKAYPAPKGKTALDMV

SEQ ID NO: 145 - DNA, 828 bp, Escherichia coli
atggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcggcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctacttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcatccgctgatgcaacaacgccagctacacgcctggaacgcgacacacaaaatccagaccgaatcctggagcccattagcgcaaggagggaaaggcgttttcgatcagaaagtcattcgcgatctggcagataaatacggcaaaaccccggcgcagattgttatccgctggcatctggatagcggcctggtggtgatcccgaaatcggtcacaccttcacgtattgccgaaaactttgatgtctgggatttccgtctcgacaaagacgaactcggcgaaattgcaaaactcgatcagggcaagcgtctcggtcccgatcctgaccagttcggcggctaa

SEQ ID NO: 146 - protein, 275 aa, Escherichia coli
MANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 147 - DNA, 975 bp, Escherichia coli
atgcaatacaaccccttaggaaaaaccgaccttcgcgtttcccgactttgcctcggctgtatgacctttggcgagccagatcgcggtaatcacgcatggacactgccggaagaaagcagccgtcccataattaaacgtgcactggaaggcggcataaatttctttgataccgccaacagttattctgacggcagcagcgaagagatcgtcggtcgcgcactgcgggatttcgcccgtcgtgaagacgtggtcgttgcgaccaaagtgttccatcgcgttggtgatttaccggaaggattatcccgtgcgcaaattttgcgctctatcgacgacagcctgcgacgtctcggcatggattatgtcgatatcctgcaaattcatcgctgggattacaacacgccgatcgaagagacgctggaagccctcaacgacgtggtaaaagccgggaaagcgcgttatatcggcgcgtcatcaatgcacgcttcgcagtttgctcaggcactggaactccaaaaacagcacggctgggcgcagtttgtcagtatgcaggatcactacaatctgatttatcgtgaagaagagcgcgagatgctaccactgtgttatcaggagggcgtggcggtaattccatggagcccgctggcaaggggccgtctgacgcgtccgtggggagaaactaccgcacgactggtgtctgatgaggtggggaaaaatctctataaagaaagcgatgaaaatgacgcgcagatcgcagagcggttaacaggcgtcagtgaagaactgggggcgacacgagcacaagttgcgctggcctggttgttgagtaaaccgggcattgccgcaccgattatcggaacttcgcgcgaagaacagcttgatgagctattgaacgcggtggatatcactttgaagccggaacagattgccgaactggaaacgccgtataaaccgcatcctgtcgtaggatttaaataa

SEQ ID NO: 148 - protein, 324 aa, Escherichia coli [sequence omitted]

SEQ ID NO: 149 - DNA, 1041 bp, Escherichia coli
atggtctggttagcgaatcccgaacgttacgggcagatgcaataccgctattgcggaaaaagtggtttacgcctgcccgcgttatcgctcggtttatggcacaatttcggtcacgttaacgcgctggaatcacagcgtgcgatcctgcgtaaagcgtttgatttgggcattacgcactttgatttagccaacaattacgggccgcctccaggaagcgcagaagagaactttggtcgcctgctgcgggaggattttgccgcttatcgcgatgaactgattatctctaccaaggctggctacgatatgtggcccggcccttacggctctggcggttcacgtaaatacctgctcgccagcctcgaccaaagcctgaagcgtatggggcttgagtatgtcgatatcttttactctcatcgcgtcgatgaaaatacgccgatggaagaaaccgcctctgcgctggctcatgcggtacaaagcggtaaggcgctgtatgtcgggatctcctcttactcgccagagcggacgcaaaaaatggtcgagttgctgcgcgagtggaaaattccgctgttaattcatcaaccttcgtacaatttactgaaccgctgggtggataaaagcggcctgctggataccctgcaaaataacggcgtgggctgtattgcctttactcctctggctcagggattgctgaccggaaaatatctcaacggcattccgcaagattcacggatgcatcgtgaagggaataaagttcgtggtctgacaccgaaaatgcttaccgaagccaacctcaacagcctgcgcttattgaatgaaatggcacagcagcgtggacaatcaatggcgcaaatggcgttaagctggttgctgaaagatgatcgcgtgacgtcggtattgattggtgccagccgcgcggagcaactagaggagaacgtgcaggcgctgaataatctgacatttagcaccaaggagctggcgcagattgatcagcatatcgccgatggcgagctgaatctgtggcaggcgtcttccgataaatga

SEQ ID NO: 150 - protein, 346 aa, Escherichia coli
MVWLANPERYGQMQYRYCGKSGLRLPALSLGLWHNFGHVNALESQRAILRKAFDLGITHFDLANNYGPPPGSAEENFGRLLREDFAAYRDELIISTKAGYDMWPGPYGSGGSRKYLLASLDQSLKRMGLEYVDIFYSHRVDENTPMEETASALAHAVQSGKALYVGISSYSPERTQKMVELLREWKIPLLIHQPSYNLLNRWVDKSGLLDTLQNNGVGCIAFTPLAQGLLTGKYLNGIPQDSRMHREGNKVRGLTPKMLTEANLNSLRLLNEMAQQRGQSMAQMALSWLLKDDRVTSVLIGASRAEQLEENVQALNNLTFSTKELAQIDQHIADGELNLWQASSDK

SEQ ID NO: 151 - DNA, 1041 bp, Escherichia coli
atgcaatatcaccgtataccccacagttcgctggaagtcagcacgctggggcttggcacgatgacgtttggtgaacagaacagcgaagccgacgcccacgcacaactcgactatgccgtcgctcagggcattaaccttatcgacgttgccgaaatgtacccagtacctccgcgccccgaaacgcaagggttaaccgaaacctacgtcggcaactggctggcgaaacatggcagccgcgaaaagttaattatcgcctccaaagtgagcggaccgtcgcgcaataatgacaagggcatccgcccggatcaggcgctggatcggaagaatatccgcgaagcgctgcatgacagcctcaagcgcctacagactgattacctcgatctttatcaggtgcactggccgcagcgcccgaccaactgcttcggcaaactcggttatagctggacggattctgcgcctgcggtttcgctgctggatacgctggacgcactggcagagtaccaacgcgcgggaaaaattcgttatatcggcgtgtcgaacgaaactgcatttggcgtaatgcgctacctgcatctggcggacaaacacgatctgccgcgtattgtcaccattcagaacccttacagtctgttaaaccgcagttttgaagtaggtctggcagaagtcagccagtatgaaggggtcgaactgctggcctattcgtgcctgggtttcggcacgctgaccgggaaatatctcaatggtgcaaaacccgctggcgcacgtaatacgctctttagtcggttcacccgctatagcggtgagcaaacgcaaaaagccgtcgcggcgtatgttgatatcgccagacgtcatggcctggaccctgctcagatggcgctcgcgtttgtacgccgtcaaccgtttgttgccagcactctgctgggcgcaaccacgatggatcagctgaaaactaacatcgaaagtttgcatctggagttaagcgaagacgtattagctgaaattgaagcggtgcatcaggtttatacttatccggcaccataa

SEQ ID NO: 152 - protein, 346 aa, Escherichia coli
MQYHRIPHSSLEVSTLGLGTMTFGEQNSEADAHAQLDYAVAQGINLIDVAEMYPVPPRPETQGLTETYVGNWLAKHGSREKLIIASKVSGPSRNNDKGIRPDQALDRKNIREALHDSLKRLQTDYLDLYQVHWPQRPTNCFGKLGYSWTDSAPAVSLLDTLDALAEYQRAGKIRYIGVSNETAFGVMRYLHLADKHDLPRIVTIQNPYSLLNRSFEVGLAEVSQYEGVELLAYSCLGFGTLTGKYLNGAKPAGARNTLFSRFTRYSGEQTQKAVAAYVDIARRHGLDPAQMALAFVRRQPFVASTLLGATTMDQLKTNIESLHLELSEDVLAEIEAVHQVYTYPAP

SEQ ID NO: 153 - DNA, 897 bp, Escherichia coli
atggttcagcgtattactattgcgccgcaaggcccggagttttcccgttttgtgatgggctactggcgattgatggactggaatatgtccgcccgccagctggtcagttttattgaagagcatctggatctcggcgtgaccaccgtggaccatgctgatatttatggtggctatcagtgcgaagcggcgtttggcgaggcactgaaactggcacctcacctgcgtgaacggatggaaatcgtcagtaaatgcggtatcgcgacgaccgcgcgtgaagaaaacgtcattggtcattacatcactgaccgcgatcacatcattaagagcgccgaacagtcgctaattaatctcgcgaccgatcatctggatttgctgttaatccaccgaccagacccgttaatggatgccgatgaagtggcggacgcgttcaaacatctgcatcagagcggcaaagtgcgtcattttggcgtatcgaactttacgcctgcgcaatttgccctgttgcaatcacgtctgccgtttacccttgccactaatcaggtggaaatatccccggtgcatcagccgttactgctggatggcacgctcgaccaactacaacaactgcgtgttcgtccgatggcgtggtcctgccttggtggtggtcgtctgtttaatgatgattatttccagccgctgcgtgatgaactggctgtggtggcagaggagttaaacgcgggctcgattgaacaggtggtttacgcctgggtattacgtttaccatcgcagccgctgccaattatcggttcaggtaaaattgagcgcgtacgggcagctgtcgaagcagaaacactgaaaatgacccgtcaacaatggtttcgtatccgtaaagcggcactggggtacgacgtaccgtaa

SEQ ID NO: 154 - protein, 298 aa, Escherichia coli
MVQRITIAPQGPEFSRFVMGYWRLMDWNMSARQLVSFIEEHLDLGVTTVDHADIYGGYQCEAAFGEALKLAPHLRERMEIVSKCGIATTAREENVIGHYITDRDHIIKSAEQSLINLATDHLDLLLIHRPDPLMDADEVADAFKHLHQSGKVRHFGVSNFTPAQFALLQSRLPFTLATNQVEISPVHQPLLLDGTLDQLQQLRVRPMAWSCLGGGRLFNDDYFQPLRDELAVVAEELNAGSIEQVVYAWVLRLPSQPLPIIGSGKIERVRAAVEAETLKMTRQQWFRIRKAALGYDVP

SEQ ID NO: 155 - DNA, 861 bp, Escherichia coli
atgagcagcaatacatttactctcggtacaaaatccgttaaccgtcttggttatggcgcgatgcaactggcaggtcctggagtttttggccccccacgagatcgccacgtcgctataaccgtgctgcgtgaggcgctggcattgggcgtcaatcatattgataccagcgacttttatggtccgcacgtcaccaatcagattatccgcgaagcgctttatccttactctgacgacctgacaattgtcactaaaattggtgcgcggcgtggagaggacgcatcctggttgcccgcattttctccggcagagctgcaaaaagcggtgcacgataatctacgtaatctcgggctggacgtgctggatgtggttaacctgcgcgttatgatgggggatggtcatggcccagcggaaggatcgattgaggccagcctgaccgtgctggcagagatgcaacaacaaggcctggtaaaacatattggcctgagcaacgtcacaccgacgcaggttgcagaggcgcgcaagattgccgaaattgtctgtgtgcaaaacgaatacaacatcgcgcaccgtgctgatgatgcaatgattgatgctttggcccacgatggcattgcctacgtgccgttcttcccgctcgggggctttacaccgctgcaatcgtccacactttccgatgttgctgcgagcctgggtgcaacaccaatgcaggtggcgctggcgtggctgttacagcgttcaccgaatattttgctgatcccagggacgtcttcggttgcgcatttacgggagaatatggctgctgaaaaattgcatctttctgaggaagtgttgtctacgttggatggtatttcgcgagaataa

SEQ ID NO: 156 - protein, 286 aa, Escherichia coli
MSSNTFTLGTKSVNRLGYGAMQLAGPGVFGPPRDRHVAITVLREALALGVNHIDTSDFYGPHVTNQIIREALYPYSDDLTIVTKIGARRGEDASWLPAFSPAELQKAVHDNLRNLGLDVLDVVNLRVMMGDGHGPAEGSIEASLTVLAEMQQQGLVKHIGLSNVTPTQVAEARKIAEIVCVQNEYNIAHRADDAMIDALAHDGIAYVPFFPLGGFTPLQSSTLSDVAASLGATPMQVALAWLLQRSPNILLIPGTSSVAHLRENMAAEKLHLSEEVLSTLDGISRE

SEQ ID NO: 157 - DNA, 810 bp, Escherichia coli
atgactcataaagcaacggagatcctgacaggtaaagttatgcaaaaatcggtcttaattaccggatgttccagtggaattggcctggaaagcgcgctcgaattaaaacgccagggttttcatgtgctggcaggttgccggaaaccggatgatgttgagcgcatgaacagcatgggatttaccggcgtgttgatcgatctggattcaccagaaagtgttgatcgcgcagccgacgaggtgatcgccctgaccgataattgtctgtatgggatctttaacaatgccggattcggcatgtatggccccctttccaccatcagccgtgcgcagatggaacagcagttttccgccaactttttcggcgcacaccagctcaccatgcgcctgttacccgcgatgttaccgcacggtgaagggcgtattgtgatgacatcatcggtgatgggattaatctccacgccgggtcgtggcgcttacgcggccagtaaatatgcgctggaggcgtggtcagatgcactgcgcatggagctgcgccacagcggaattaaagtcagcctgatcgaacccggtcccattcgtactcgcttcaccgacaacgtcaaccagacgcaaagtgataaaccagtcgaaaatcccggcatcgccgcccgctttacgttgggaccggaagcggtggtggacaaagtacgccatgcttttattagcgagaagccgaagatgcgctatccggtgacgctggtgacctgggcggtaatggtgcttaagcgcctgctgccggggcgcgtgatggacaaaatattgcaggggtga

SEQ ID NO: 158 - protein, 269 aa, Escherichia coli
MTHKATEILTGKVMQKSVLITGCSSGIGLESALELKRQGFHVLAGCRKPDDVERMNSMGFTGVLIDLDSPESVDRAADEVIALTDNCLYGIFNNAGFGMYGPLSTISRAQMEQQFSANFFGAHQLTMRLLPAMLPHGEGRIVMTSSVMGLISTPGRGAYAASKYALEAWSDALRMELRHSGIKVSLIEPGPIRTRFTDNVNQTQSDKPVENPGIAARFTLGPEAVVDKVRHAFISEKPKMRYPVTLVTWAVMVLKRLLPGRVMDKILQG

SEQ ID NO: 159 - DNA, 762 bp, Escherichia coli
atggcacaggttgcgattattaccgcctccgattcggggatcggcaaagagtgcgcgttattactggcgcagcaggggtttgatattggtattacctggcactcagatgaagaaggggcaaaagataccgcgcgtgaggtagttagccacggcgtacgtgcggagatcgtgcagctggatctcggcaatctaccagaaggggcactggcgctggagaaactcattcaacggctggggcgcattgatgtgctggtgaataatgcgggtgcaatgaccaaagcgccgtttcttgatatggcttttgatgagtggcgcaagatttttaccgttgatgtcgatggtgcattcttatgctcgcaaattgcggctcgtcagatggtgaaacaagggcagggcggtcgcatcatcaacattacgtcggtacatgaacatacgccgctgccggatgccagcgcctacacagccgctaaacatgcgctcggtgggttaaccaaagcgatggcgctggagctggtcaggcataagattttggtgaacgcagtcgcgcctggggcgatcgccacgccaatgaatggcatggatgacagcgacgtgaagcccgacgcggagccttcgattcccttgcggcgttttggcgcaacgcatgagattgccagcctggtggtgtggctttgttcggagggcgcaaattacaccaccgggcagtcgttgatagtggatggcggctttatgttggcgaatccacagttcaacccagaatag

SEQ ID NO: 160 - protein, 253 aa, Escherichia coli
MAQVAIITASDSGIGKECALLLAQQGFDIGITWHSDEEGAKDTAREVVSHGVRAEIVQLDLGNLPEGALALEKLIQRLGRIDVLVNNAGAMTKAPFLDMAFDEWRKIFTVDVDGAFLCSQIAARQMVKQGQGGRIINITSVHEHTPLPDASAYTAAKHALGGLTKAMALELVRHKILVNAVAPGAIATPMNGMDDSDVKPDAEPSIPLRRFGATHEIASLVVWLCSEGANYTTGQSLIVDGGFMLANPQFNPE

SEQ ID NO: 161 - DNA, 759 bp, Escherichia coli
atgcattaccagccaaaacaagatttactcaatgatcgcattatcctggtgacgggagccagcgatggtattggtcgtgaagccgcgatgacgtatgcacgctatggtgcgacagtgattctgttgggccgtaatgaagaaaaattacgtcaggtagccagccacataaacgaagaaactgggcgtcagccacagtggtttattctcgatttgctgacctgcacgtccgaaaattgccaacaactggcacagcgcattgccgttaattatccgcgtctggatggtgttttgcataatgccggattgctcggcgatgtttgcccaatgagcgaacaaaatccgcaggtctggcaggacgtcatgcaggtcaacgttaatgccacctttatgctcacccaggcactgcttcctttattactcaaatcggacgccggttcactggtctttacttcatcaagcgttggacgtcagggacgagccaactggggtgcatatgcagcgtcgaaatttgccaccgaagggatgatgcaggtactggccgatgaatatcagcagcgcctgcgtgtcaactgcattaacccaggcggtacgcgcaccgcaatgcgtgccagcgccttcccgaccgaagatccacagaaacttaaaacacccgctgatatcatgccgctctacctctggctgatgggcgatgacagccgccgtaaaaccggcatgacctttgacgcccaaccgggccgtaaaccaggaatttcccaatga

SEQ ID NO: 162 - protein, 252 aa, Escherichia coli
MHYQPKQDLLNDRIILVTGASDGIGREAAMTYARYGATVILLGRNEEKLRQVASHINEETGRQPQWFILDLLTCTSENCQQLAQRIAVNYPRLDGVLHNAGLLGDVCPMSEQNPQVWQDVMQVNVNATFMLTQALLPLLLKSDAGSLVFTSSSVGRQGRANWGAYAASKFATEGMMQVLADEYQQRLRVNCINPGGTRTAMRASAFPTEDPQKLKTPADIMPLYLWLMGDDSRRKTGMTFDAQPGRKPGISQ

SEQ ID NO: 163 - DNA, 744 bp, Escherichia coli
atggctatagcacttgtgactggtggcagtcgcggcatcgggcgggcaactgcattactgttggcgcaagaagggtatacggtggcggttaattatcagcaaaacctccacgcggcgcaggaagtgatgaacttaataacgcaagccggtggcaaagcattcgtgctccaggcggatatcagcgacgaaaaccaggtcgttgcgatgtttacagcaatcgatcagcacgatgaaccgctagcagcgctggtcaataacgccgggatcttgtttacccagtgcaccgttgaaaaccttaccgcagagcgaatcaaccgagtactttccaccaacgtgacgggatattttctctgctgccgcgaggcggtaaaacgcatggcgcttaaaaatggtggcagtggcggcgctatcgtcaatgtctcttcggtggcctcacggttgggttcgccaggggaatatgttgattacgcggcatcgaaaggggcgattgatacgttaaccaccggactatcgctggaagtcgccgcgcaggggatccgcgttaactgcgtgcggccagggtttatttataccgaaatgcacgccagcggcggcgagcctggacgcgtcgatcgcgttaagtcgaacatccccatgcagcgtggtggacaggcagaagaggtcgcgcaggccattgtctggctactaagtgataaagcctcttacgtcacgggaagttttatcgatttggcgggcgggaaataa

SEQ ID NO: 164 - protein, 247 aa, Escherichia coli
MAIALVTGGSRGIGRATALLLAQEGYTVAVNYQQNLHAAQEVMNLITQAGGKAFVLQADISDENQVVAMFTAIDQHDEPLAALVNNAGILFTQCTVENLTAERINRVLSTNVTGYFLCCREAVKRMALKNGGSGGAIVNVSSVASRLGSPGEYVDYAASKGAIDTLTTGLSLEVAAQGIRVNCVRPGFIYTEMHASGGEPGRVDRVKSNIPMQRGGQAEEVAQAIVWLLSDKASYVTGSFIDLAGGK

SEQ ID NO: 165 - DNA, 885 bp, Escherichia coli
atgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaataggtcgcgctgccgccatcgcttacgcgcgtgaaggggctgacgtggcgatcagttatcttcccgtggaagaagaagacgctcaggatgtgaaaaagatcattgaagaatgcggacgcaaagccgttctgctgccaggcgatttaagcgatgagaaatttgcccgttcgctggttcacgaagcgcacaaggcgttaggcgggctggatattatggcgctggtcgccgggaaacaggttgccattccggatattgcagacctcaccagcgaacagtttcaaaagacctttgccattaacgttttcgcgctgttctggctaacccaggaagcgatccccctgctaccgaaaggtgcaagtatcatcaccacttcgtcaatccaggcataccagccaagtccgcatttactggactatgcggctacgaaggcggcgattctgaactacagccgtggcttggcaaaacaggtcgcggagaaaggtattcgggtgaatattgtcgcgccaggcccgatctggacagcactgcaaatttccggcggacaaacgcaggataagatcccgcagtttggtcagcaaacgccgatgaaacgtgcggggcaaccggcggaactggcccctgtatatgtttatctggcaagtcaggagtcgagctacgtcaccgcagaagtgcacggcgtgtgcggcggcgagcatttaggttaa

SEQ ID NO: 166 - protein, 294 aa, Escherichia coli
MSHLKDPTTQYYTGEYPKQKQPTPGIQAKMTPVPDCGEKTYVGSGRLKDRKALVTGGDSGIGRAAAIAYAREGADVAISYLPVEEEDAQDVKKIIEECGRKAVLLPGDLSDEKFARSLVHEAHKALGGLDIMALVAGKQVAIPDIADLTSEQFQKTFAINVFALFWLTQEAIPLLPKGASIITTSSIQAYQPSPHLLDYAATKAAILNYSRGLAKQVAEKGIRVNIVAPGPIWTALQISGGQTQDKIPQFGQQTPMKRAGQPAELAPVYVYLASQESSYVTAEVHGVCGGEHLG

SEQ ID NO: 167 - DNA, 714 bp, Escherichia coli
atgggcgcttttacaggtaagacagttctcatcctcggtggcagtcgtggtatcggtgccgctatcgtacgtcgtttcgtcaccgatggggccaatgtacgattcacctatgcggggtcgaaagatgccgctaaacgcctggcacaagagactggagcgacagcagtattcacagatagtgctgacagagacgctgtcattgatgtcgttcgtaagagcggcgcattggatatcctggtggtaaatgcaggtattggcgtctttggcgaggccctggaattaaatgccgacgatattgatcgccttttcaaaatcaatattcatgctccttatcatgcctctgttgaagccgcccggcagatgcccgaaggcgggcgcatcttaatcatcggctccgtgaatggcgatcgtatgcctgttgcaggcatggctgcttatgccgccagcaaatctgccctgcaaggcatggcgcgcgggctggcccgtgattttggaccgcgtgggatcaccattaacgtcgtccagccagggccaattgataccgacgctaatcccgccaacgggccaatgcgcgatatgttgcatagtttgatggctatcaaaagacatgggcaaccggaagaggtcgctggtatggtcgcatggttagcagggccagaagccagttttgttaccggcgcgatgcataccattgatggcgcgtttggcgcataa

SEQ ID NO: 168 - protein, 237 aa, Escherichia coli
MGAFTGKTVLILGGSRGIGAAIVRRFVTDGANVRFTYAGSKDAAKRLAQETGATAVFTDSADRDAVIDVVRKSGALDILVVNAGIGVFGEALELNADDIDRLFKINIHAPYHASVEAARQMPEGGRILIIGSVNGDRMPVAGMAAYAASKSALQGMARGLARDFGPRGITINVVQPGPIDTDANPANGPMRDMLHSLMAIKRHGQPEEVAGMVAWLAGPEASFVTGAMHTIDGAFGA

SEQ ID NO: 169 - DNA, 747 bp, Escherichia coli
atgatcgttttagtaactggagcaacggcaggttttggtgaatgcattactcgtcgttttattcaacaagggcataaagttatcgccactggccgtcgccaggaacggttgcaggagttaaaagacgaactgggagataatctgtatatcgcccaactggacgttcgcaaccgcgccgctattgaagagatgctggcatcgcttcctgccgagtggtgcaatattgatatcctggtaaataatgccggcctggcgttgggcatggagcctgcgcataaagccagcgttgaagactgggaaacgatgattgataccaacaacaaaggcctggtatatatgacgcgcgccgtcttaccgggtatggttgaacgtaatcatggtcatattattaacattggctcaacggcaggtagctggccgtatgccggtggtaacgtttacggtgcgacgaaagcgtttgttcgtcagtttagcctgaatctgcgtacggatctgcatggtacggcggtgcgcgtcaccgacatcgaaccgggtctggtgggtggtaccgagttttccaatgtccgctttaaaggcgatgacggtaaagcagaaaaaacctatcaaaataccgttgcattgacgccagaagatgtcagcgaagccgtctggtgggtgtcaacgctgcctgctcacgtcaatatcaataccctggaaatgatgccggttacccaaagctatgccggactgaatgtccaccgtcagtaa

SEQ ID NO: 170 - protein, 248 aa, Escherichia coli
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 171 - DNA, 786 bp, Escherichia coli
atgtcaatcgaatctctcaatgcgttctcaatggattttttctccctgaaaggtaaaaccgcaattgttaccggtgggaatagcggtttaggccaggcatttgccatggcgttggccaaagctggcgcaaatatctttattcctagtttcgtcaaagataacggcgaaacaaaggaaatgattgaaaaacagggtgttgaggtggacttcatgcaggtgggtatcaccgcagaaggcgcgccgcagaagattatcgctgcttgctgtgagcgtttcggtacagttgatattctggttaacaatgccggtatttgtaagctgaataaggtgctggacttcggtcgtgccgactgggatccgatgattgatgtgaacctgaccgccgcattcgagttaagctatgaagctgcaaaaattatgatcccgcagaaaagcggcaaaattattaatatctgttcattgttctcttacttaggtggacaatggtcacctgcatattctgccactaaacatgctcttgccgggttcaccaaagcttattgtgatgaactaggtcaatataatattcaggtaaatggtatcgcccctggctattatgcaacagatattacgctggcgacacgcagtaatccagaaaccaatcagcgcgttcttgatcatattccggcaaaccgttggggcgatactcaggatttaatgggcgcagccgtattcctcgcaagtccggcatcgaattatgtcaacgggcatttattagtggttgatggcggttatttagtgcgctaa

SEQ ID NO: 172 - protein, 261 aa, Escherichia coli
MSIESLNAFSMDFFSLKGKTAIVTGGNSGLGQAFAMALAKAGANIFIPSFVKDNGETKEMIEKQGVEVDFMQVGITAEGAPQKIIAACCERFGTVDILVNNAGICKLNKVLDFGRADWDPMIDVNLTAAFELSYEAAKIMIPQKSGKIINICSLFSYLGGQWSPAYSATKHALAGFTKAYCDELGQYNIQVNGIAPGYYATDITLATRSNPETNQRVLDHIPANRWGDTQDLMGAAVFLASPASNYVNGHLLVVDGGYLVR

SEQ ID NO: 173 - DNA, 792 bp, Escherichia coli
tcagataccgacgctaaccgtctccggcagtgtgctgccgccatcaatcacattctgtgtaccggttaaatagctggattcatccgatgcgaggaaggccgccagttcgccgacttccagcggatcggcgaggcgacgcatcgggattgctttcgccatttcagtcagcaccgactctggatcttccgggttcgactggcgggcaatgctttccgccattggtgtgcgcacgtatcccgggcaaatggcgttaacgcgaataccagactgcgcgtactccaccgccagcgattttgtcaggccaacaatcgccgctttcgttaaggcgtacgccgtttcgccaggatcggccaccatatcaccagtgactgaagacatcatcacaatgcgaccatctttgcgggcaatcatctccggcagcaccgccttcgtgacgttccatacgcctttaatattgatgtcaatatggaaatcgcgatcgtcatcgctcatatcgaggaaactgcccagacgacaaacgcctgcgttattcaccaggatatcaatgcgcccttctttttccttcgcgcgtttgatagctgcggctaccgacgccgggtcacgcacatcggcgacaaccgccgtacagcgatgaccacgaccacacagttcgtccgccagcttttcgatctcaggggagatatccagcaagattaggttcgcgccatgacgtgcaaaagttctggcaattccttcgccaattccctgcaatgcgcccgtaatcagtgctgtcttgcccgtgagtttacccat

SEQ ID NO: 174 - protein, 263 aa, Escherichia coli
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 175 - DNA, 747 bp, Escherichia coli
atggatttcagcggtaaaaatgtctgggtaaccggcgcaggtaaaggtatcggctacgccacggcgctggcgtttgttgaggcgggagcgaaagttacaggttttgatcaagcgttcactcaggagcaatatccctttgcgaccgaagtgatggatgttgccgacgctgcgcaggtcgcgcaagtgtgtcagcgactgttagctgaaacggagcgactggacgcgctggtcaatgcggcgggaattttacgcatgggcgcgaccgatcagctcagtaaagaggactggcagcagacttttgcggttaacgtcggcggtgcgtttaacctgttccagcaaaccatgaaccagtttcgccgtcagcggggcggggcgattgtcactgtggcgtccgacgccgcgcacacgccgcgtattggcatgagtgcttatggcgcatcgaaagcggcgctgaaaagcctggcgttgagcgtcgggctggaactggcgggtagcggcgtgcgctgtaatgtggtttcgcctggctccaccgacaccgatatgcaacgcacgctgtgggtgagcgatgacgccgaagaacagcgtattcgcggctttggcgagcagtttaaactcggcattccgctggggaaaatcgcccgtccacaagagatcgccaacacgattttgttcctcgcctctgacctcgccagccatattaccctacaggatattgtggtcgatggcggctcaacgctgggggcataa

SEQ ID NO: 176 - protein, 248 aa, Escherichia coli
MDFSGKNVWVTGAGKGIGYATALAFVEAGAKVTGFDQAFTQEQYPFATEVMDVADAAQVAQVCQRLLAETERLDALVNAAGILRMGATDQLSKEDWQQTFAVNVGGAFNLFQQTMNQFRRQRGGAIVTVASDAAHTPRIGMSAYGASKAALKSLALSVGLELAGSGVRCNVVSPGSTDTDMQRTLWVSDDAEEQRIRGFGEQFKLGIPLGKIARPQEIANTILFLASDLASHITLQDIVVDGGSTLGA

SEQ ID NO: 177 - DNA, 723 bp, Escherichia coli
atgggtaaaacccagcccttgccaatattaattactggcggaggtcgtcgcatcggcctcgccctcgcatggcatttcattaatcaaaagcaaccggtgattgtcagctatcggacacactatccagccattgatggactgattaatgcaggtgcgcagtgtattcaggctgatttttcgaccaacgacggtgtgatggcgtttgccgatgaagtactaaaaagcacccatggtctgcgtgctattttgcataacgccagtgcgtggatggcggaaaaaccgggtgcgccactggccgacgtactggcttgcatgatgcagatccacgttaataccccatacctgctcaaccatgcgctggaaagattactgcgtgggcacggacacgccgccagcgatatcattcactttaccgattatgtggtggagcgcggtagcgacaaacatattgcgtatgctgcaagcaaagcggcactggataatatgacccgctcgtttgcccgcaagctggcaccggaagtgaaagtgaattctattgcgccatcgctgatcctgtttaatgaacatgatgatgccgaatatcgacaacaggcgctgaataaatcactgatgaaaaccgcgcctggcgagaaagaagtgatcgacctggtcgattacttacttaccagttgctttgtcaccggacgcagtttcccacttgatggcggtcgtcatctgcgttaa

SEQ ID NO: 178 - protein, 240 aa, Escherichia coli
MGKTQPLPILITGGGRRIGLALAWHFINQKQPVIVSYRTHYPAIDGLINAGAQCIQADFSTNDGVMAFADEVLKSTHGLRAILHNASAWMAEKPGAPLADVLACMMQIHVNTPYLLNHALERLLRGHGHAASDIIHFTDYVVERGSDKHIAYAASKAALDNMTRSFARKLAPEVKVNSIAPSLILFNEHDDAEYRQQALNKSLMKTAPGEKEVIDLVDYLLTSCFVTGRSFPLDGGRHLR

SEQ ID NO: 179 - DNA, 768 bp, Escherichia coli
gtgtttaattctgacaacctgagactcgacggaaaatgcgccatcatcacaggtgcgggtgcaggtattggtaaagaaatcgccattacattcgcgacagctggcgcatctgtggtggtcagtgatattaacgccgacgcagctaaccatgttgtagacgaaattcaacaactgggtggtcaggcatttgcctgccgttgtgatattacttccgaacaggaactctctgcactggcagactttgctatcagtaagctgggtaaagttgatattctggttaacaacgccggtggcggtggacctaaaccgtttgatatgccaatggcggattttcgccgtgcttatgaactgaatgtgttttcttttttccatctgtcacaacttgttgcgccagaaatggaaaaaaatggcggtggcgttattctgaccatcacttctatggcggcagaaaataaaaatataaacatgacttcctatgcatcatctaaagctgcggccagtcatctggtcagaaatatggcgtttgacctgggtgaaaaaaatattcgggtaaatggcattgcgccgggggcaatattaaccgatgccctgaaatccgttattacaccagaaattgaacaaaaaatgttacagcacacgccgatcagacgtctgggccaaccgcaagatattgctaacgcagcgctgttcctttgctcgcctgctgcgagctgggtaagcggacaaattctcaccgtctccggtggtggggtacaggagctcaattaa

SEQ ID NO: 180 - protein, 255 aa, Escherichia coli
MFNSDNLRLDGKCAIITGAGAGIGKEIAITFATAGASVVVSDINADAANHVVDEIQQLGGQAFACRCDITSEQELSALADFAISKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 181 - DNA, 813 bp, Escherichia coli
atgagcgatctgcataacgagtccatttttattaccggcggcggatcgggattagggctggcgctggtcgagcgatttatcgaagaaggcgcgcaggttgccacgctggaactgtcggcggcaaaagtcgccagtctgcgtcagcgatttggcgaacatattctggcggtggaaggtaacgtgacctgttatgccgattatcaacgcgcggtcgatcagatcctgactcgttccggcaagctggattgttttatcggcaatgcaggcatctgggatcacaatgcctcactggttaatactcccgcagagacgctcgaaaccggcttccacgagctgtttaacgtcaatgttctcggttacctgctgggcgcaaaagcctgcgctccggcgttaatcgccagtgaaggcagcatgattttcacactgtcaaatgccgcctggtatcctggcggcggtggcccgctgtacaccgccagtaaacatgccgcaaccggacttattcgccaactggcttatgaactggcaccgaaagtgcgggtgaatggcgtcggcccgtgtggtatggccagcgacctgcgcggcccacaggcgctcgggcaaagtgaaacctcgataatgcagtctctgacgccggagaaaattgccgccattttaccgctgcaatttttcccgcaaccggcggattttacggggccgtatgtgatgttgacatcgcggcgcaataatcgcgcattaagcggtgtgatgatcaacgctgatgcgggtttagcgattcgcggcattcgccacgtagcggctgggctggatctttaa

SEQ ID NO: 182 - protein, 270 aa, Escherichia coli
MSDLHNESIFITGGGSGLGLALVERFIEEGAQVATLELSAAKVASLRQRFGEHILAVEGNVTCYADYQRAVDQILTRSGKLDCFIGNAGIWDHNASLVNTPAETLETGFHELFNVNVLGYLLGAKACAPALIASEGSMIFTLSNAAWYPGGGGPLYTASKHAATGLIRQLAYELAPKVRVNGVGPCGMASDLRGPQALGQSETSIMQSLTPEKIAAILPLQFFPQPADFTGPYVMLTSRRNNRALSGVMINADAGLAIRGIRHVAAGLDL

SEQ ID NO: 183 - DNA, 780 bp, Escherichia coli
atgaatcaggttgccgttgtcatcggtggtgggcaaaccttaggcgcgttcctgtgccacggtctggctgccgaggggtatcgcgtcgcggttgtcgatattcagagcgacaaagccgcaaatgtggcacaagaaattaacgccgaatatggtgaaagtatggcgtacggttttggtgctgacgccactagcgagcaaagcgttctggcgctctctcgtggggtagatgaaatctttggtcgcgtggatttgctggtctacagcgccggaatagcaaaagcagcctttatcagcgacttccagctcggcgattttgaccgttcgctacaggtgaatctggtgggttatttcctgtgtgcgcgtgaattttcgcgtttgatgatccgcgacgggattcaggggcgcattattcagatcaactcgaaatccggcaaagtgggcagcaaacacaactctggctacagcgcagcgaaatttggtggcgtcgggctgactcaatcactggcgctggatctggcggagtacggcattacggtgcattcactgatgctcggtaacctgctgaaatcgccgatgttccagtcactgttgccacaatacgcgaccaagctgggtatcaaaccggatcaagtcgagcagtattacatcgacaaagtaccgctcaaacgcggctgcgattatcaagatgtgctgaatatgctgctgttctacgccagtcctaaggcgtcgtactgcaccggacagtcgatcaatgtcaccggcggtcaggtgatgttctga

SEQ ID NO: 184 - protein, 259 aa, Escherichia coli
MNQVAVVIGGGQTLGAFLCHGLAAEGYRVAVVDIQSDKAANVAQEINAEYGESMAYGFGADATSEQSVLALSRGVDEIFGRVDLLVYSAGIAKAAFISDFQLGDFDRSLQVNLVGYFLCAREFSRLMIRDGIQGRIIQINSKSGKVGSKHNSGYSAAKFGGVGLTQSLALDLAEYGITVHSLMLGNLLKSPMFQSLLPQYATKLGIKPDQVEQYYIDKVPLKRGCDYQDVLNMLLFYASPKASYCTGQSINVTGGQVMF

SEQ ID NO: 185 - DNA, 762 bp, Escherichia coli
atgattttaagtgcattttctctcgaaggtaaagttgcggtcgtcactggttgtgatactggactgggtcaggggatggcgttggggctggcgcaagcgggctgtgacattgttggcattaacatcgttgaaccgactgaaaccatcgagcaggtcacagcgctggggcgtcgttttttaagcctgaccgccgatctgcgaaagattgatggtattccagcactgctggatcgcgcggtagcggagtttggtcatattgatatcctggtgaataacgccggattgattcgccgcgaagatgctctcgagttcagcgaaaaggactgggacgatgtcatgaacctgaatatcaagagcgtattcttcatgtctcaggcagcggcgaaacactttatcgcgcaaggcaatggcggcaagattatcaatatcgcgtcaatgctctccttccagggcgggatccgtgtgccttcttataccgcatcaaaaagcggcgtgatgggtgtgacgcgattgatggcgaacgaatgggctaaacacaacattaatgttaatgcgatagccccgggttacatggcgaccaacaatactcaacaactacgggcagatgaacaacgtagcgcggaaattctcgaccgcattccagctggtcgttggggactgccgagtgacctgatggggccgatagtgttccttgcctccagcgcttcagattatgtgaatggttataccattgccgtggatggcggttggctggcgcgttaa

SEQ ID NO: 186 - protein, 253 aa, Escherichia coli
MILSAFSLEGKVAVVTGCDTGLGQGMALGLAQAGCDIVGINIVEPTETIEQVTALGRRFLSLTADLRKIDGIPALLDRAVAEFGHIDILVNNAGLIRREDALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPIVFLASSASDYVNGYTIAVDGGWLAR

SEQ ID NO: 187 - DNA, 765 bp, Escherichia coli
atgaacgatctattttcactggcaggaaaaaatatcttgattaccggttcagcacagggcattggctttttactggcaaccggcctgggtaaatatggcgcacaaataattattaatgatattactgccgaacgcgcagaacttgctgtagaaaaactccaccaggagggtattcaggccgttgccgcaccttttaatgttactcataaacatgaaattgatgccgccgttgaacatatcgaaaaggacatcggccccattgatgtgctggtgaataacgccggtatccagcgccgtcatccttttactgagttccctgaacaagagtggaatgatgtgatcgcagtaaaccagaccgccgtgttcctggtatcgcaagcggtaactcgtcacatggttgaacgcaaggcaggtaaagttattaatatttgctcgatgcaaagcgaactgggacgtgacaccatcaccccttatgccgcatcgaaaggggcggtaaaaatgctcacccgcggcatgtgcgtcgagctggcgcgccacaatattcaggtcaacggtattgcgccgggctatttcaaaacagaaatgactaaagcactggttgaggacgaagccttcaccgcctggttgtgcaaacggacccccgccgcacgctggggagatccgcaggaactgattggtgctgcggtgttcctttcttcaaaagcctctgatttcgtaaacggccacctgttgtttgttgatggcggcatgttagtggctgtttaa

SEQ ID NO: 188 - protein, 254 aa, Escherichia coli
MNDLFSLAGKNILITGSAQGIGFLLATGLGKYGAQIIINDITAERAELAVEKLHQEGIQAVAAPFNVTHKHEIDAAVEHIEKDIGPIDVLVNNAGIQRRHPFTEFPEQEWNDVIAVNQTAVFLVSQAVTRHMVERKAGKVINICSMQSELGRDTITPYAASKGAVKMLTRGMCVELARHNIQVNGIAPGYFKTEMTKALVEDEAFTAWLCKRTPAARWGDPQELIGAAVFLSSKASDFVNGHLLFVDGGMLVAV

SEQ ID NO: 189 - DNA, 735 bp, Escherichia coli
atgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctga

SEQ ID NO: 190 - protein, 244 aa, Escherichia coli
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 191 - DNA, 789 bp, Escherichia coli
atgggttttctttccggtaagcgcattctggtaaccggtgttgccagcaaactatccatcgcctacggtatcgctcaggcgatgcaccgcgaaggagctgaactggcattcacctaccagaacgacaaactgaaaggccgcgtagaagaatttgccgctcaattgggttctgacatcgttctgcagtgcgatgttgcagaagatgccagcatcgacaccatgttcgctgaactggggaaagtttggccgaaatttgacggtttcgtacactctattggttttgcacctggcgatcagctggatggtgactatgttaacgccgttacccgtgaaggcttcaaaattgcccacgacatcagctcctacagcttcgttgcaatggcaaaagcttgccgctccatgctgaatccgggttctgccctgctgaccctttcctaccttggcgctgagcgcgctatcccgaactacaacgttatgggtctggcaaaagcgtctctggaagcgaacgtgcgctatatggcgaacgcgatgggtccggaaggtgtgcgtgttaacgccatctctgctggtccgatccgtactctggcggcctccggtatcaaagacttccgcaaaatgctggctcattgcgaagccgttaccccgattcgccgtaccgttactattgaagatgtgggtaactctgcggcattcctgtgctccgatctctctgccggtatctccggtgaagtggtccacgttgacggcggtttcagcattgctgcaatgaacgaactcgaactgaaataa

SEQ ID NO: 192 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGISGEVVHVDGGFSIAAMNELELK

SEQ ID NO: 193 - DNA, 552 bp, Escherichia coli
atggatgcactcgaactattgatcaatcgccgtagcgcctcccgcttggctgaacccgcgccaacgggtgaacaactgcaaaacatcctgcgtgcgggtatgcgtgcgccggaccataagtccatgcaaccgtggcatttttttgtgattgaaggggaagggcgcgagcgtttcagcgccgtactggaacagggggcgattgctgccggtagtgatgacaaagctatcgacaaagcccgtaatgcgccgttccgcgcaccgctcatcatcacggtggtggcgaaatgcgaagagaatcataaagtcccgcgctgggaacaggaaatgtctgccggatgcgcggtcatggcgatgcaaatggcagcagttgcccaggggtttggcggcatctggcgcagtggcgcattaactgaaagtccggtagtgcgtgaagcattcggttgccgtgagcaggataaaattgtcggttttctctacctcggtacgccgcagctgaaagcatctacgtcgattaacgtcccggacccgacgccgtttgtaacttatttctga

SEQ ID NO: 194 - protein, 183 aa, Escherichia coli
MDALELLINRRSASRLAEPAPTGEQLQNILRAGMRAPDHKSMQPWHFFVIEGEGRERFSAVLEQGAIAAGSDDKAIDKARNAPFRAPLIITVVAKCEENHKVPRWEQEMSAGCAVMAMQMAAVAQGFGGIWRSGALTESPVVREAFGCREQDKIVGFLYLGTPQLKASTSINVPDPTPFVTYF

SEQ ID NO: 195 - DNA, 1026 bp, Synechococcus elongatus
atgttcggtcttatcggtcatctcaccagtttggagcaggcccgcgacgtttctcgcaggatgggctacgacgaatacgccgatcaaggattggagttttggagtagcgctcctcctcaaatcgttgatgaaatcacagtcaccagtgccacaggcaaggtgattcacggtcgctacatcgaatcgtgtttcttgccggaaatgctggcggcgcgccgcttcaaaacagccacgcgcaaagttctcaatgccatgtcccatgcccaaaaacacggcatcgacatctcggccttggggggctttacctcgattattttcgagaatttcgatttggccagtttgcggcaagtgcgcgacactaccttggagtttgaacggttcaccaccggcaatactcacacggcctacgtaatctgtagacaggtggaagccgctgctaaaacgctgggcatcgacattacccaagcgacagtagcggttgtcggcgcgactggcgatatcggtagcgctgtctgccgctggctcgacctcaaactgggtgtcggtgatttgatcctgacggcgcgcaatcaggagcgtttggataacctgcaggctgaactcggccggggcaagattctgcccttggaagccgctctgccggaagctgactttatcgtgtgggtcgccagtatgcctcagggcgtagtgatcgacccagcaaccctgaagcaaccctgcgtcctaatcgacgggggctaccccaaaaacttgggcagcaaagtccaaggtgagggcatctatgtcctcaatggcggggtagttgaacattgcttcgacatcgactggcagatcatgtccgctgcagagatggcgcggcccgagcgccagatgtttgcctgctttgccgaggcgatgctcttggaatttgaaggctggcatactaacttctcctggggccgcaaccaaatcacgatcgagaagatggaagcgatcggtgaggcatcggtgcgccacggcttccaacccttggcattggcaatttga

SEQ ID NO: 196 - protein, 341 aa, Synechococcus elongatus
MFGLIGHLTSLEQARDVSRRMGYDEYADQGLEFWSSAPPQIVDEITVTSATGKVIHGRYIESCFLPEMLAARRFKTATRKVLNAMSHAQKHGIDISALGGFTSIIFENFDLASLRQVRDTTLEFERFTTGNTHTAYVICRQVEAAAKTLGIDITQATVAVVGATGDIGSAVCRWLDLKLGVGDLILTARNQERLDNLQAELGRGKILPLEAALPEADFIVWVASMPQGVVIDPATLKQPCVLIDGGYPKNLGSKVQGEGIYVLNGGVVEHCFDIDWQIMSAAEMARPERQMFACFAEAMLLEFEGWHTNFSWGRNQITIEKMEAIGEASVRHGFQPLALAI

SEQ ID NO: 197 - DNA, 50 bp, Artificial Sequence
  Description of Artificial Sequence: Synthetic primer
catatcaggcgttgccaaatacacatagctaatcaggagtaaacacaatg

SEQ ID NO: 198 - DNA, 50 bp, Artificial Sequence
  Description of Artificial Sequence: Synthetic primer
aatcgcacactaacagactgaaaaaattaataaataccctgtggtttaac

SEQ ID NO: 199 - DNA, 38 bp, Artificial Sequence
  Description of Artificial Sequence: Synthetic primer
aatcctggcatcgatgataaaaagctatgccgcaaaag

SEQ ID NO: 200 - DNA, 38 bp, Artificial Sequence
  Description of Artificial Sequence: Synthetic primer
ataaaagctttcaaaaatcggctttcaacaccacgcgg

SEQ ID NO: 201 - DNA, 36 bp, Artificial Sequence
  Description of Artificial Sequence: Synthetic primer
gaccacgtgatcggcccccatagctttgagctcatc

SEQ ID NO: 202 - DNA, 36 bp, Artificial Sequence
  Description of Artificial Sequence: Synthetic primer
gatgagctcaaagctatgggggccgatcacgtggtc

SEQ ID NO: 203 - DNA, 42 bp, Artificial Sequence
  Description of Artificial Sequence: Synthetic primer
aataccatggcaacaactaatgtgattcatgcttatgctgca

SEQ ID NO: 204 - DNA, 42 bp, Artificial Sequence
  Description of Artificial Sequence: Synthetic primer
ataaaagcttttaaaaatcggctttaagtacaatccgataac

SEQ ID NO: 205 - DNA, 71 bp, Artificial Sequence
  Description of Artificial Sequence: Synthetic primer
taaccggcgtctgacgactgacttaacgctcaggctttattgtccactttgtgtaggctggagctgcttcg

SEQ ID NO: 206 - DNA, 75 bp, Artificial Sequence
  Description of Artificial Sequence: Synthetic primer
catttggggttgcgatgacgacgaacacgcattttagaggtgaagaattgcatatgaatatcctcctttagttcc

SEQ ID NO: 207 - DNA, 20 bp, Artificial Sequence
  Description of Artificial Sequence: Synthetic primer
cgtccgtggtaatcatttgg

SEQ ID NO: 208 - DNA, 18 bp, Artificial Sequence
  Description of Artificial Sequence: Synthetic primer
tcgcaaccttttcgttgg

SEQ ID NO: 209 - DNA, 70 bp, Artificial Sequence
  Description of Artificial Sequence: Synthetic primer
gcgcctcagatcagcgctgcgaatgattttcaaaaatcggctttcaacactgtaggctggagctgcttcg

SEQ ID NO: 210 - DNA, 70 bp, Artificial Sequence
  Description of Artificial Sequence: Synthetic primer
ctgccatgctctacacttcccaaacaacaccagagaaggaccaaaaaatgattccggggatccgtcgacc

SEQ ID NO: 211 - DNA, 22 bp, Artificial Sequence
  Description of Artificial Sequence: Synthetic primer
gtgctggcgatacgacaaaaca

SEQ ID NO: 212 - DNA, 23 bp, Artificial Sequence
  Description of Artificial Sequence: Synthetic primer
ccccgccctgccatgctctacac

SEQ ID NO: 213 - DNA, 10097 bp, Artificial Sequence
  Description of Artificial Sequence: Synthetic polynucleotide
cactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcgtcggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatgaccagcgatgttcacgacgccacagacggcgtcaccgaaaccgcactcgacgacgagcagtcgacccgccgcatcgccgagctgtacgccaccgatcccgagttcgccgccgccgcaccgttgcccgccgtggtcgacgcggcgcacaaacccgggctgcggctggcagagatcctgcagaccctgttcaccggctacggtgaccgcccggcgctgggataccgcgcccgtgaactggccaccgacgagggcgggcgcaccgtgacgcgtctgctgccgcggttcgacaccctcacctacgcccaggtgtggtcgcgcgtgcaagcggtcgccgcggccctgcgccacaacttcgcgcagccgatctaccccggcgacgccgtcgcgacgatcggtttcgcgagtcccgattacctgacgctggatctcgtatgcgcctacctgggcctcgtgagtgttccgctgcagcacaacgcaccggtcagccggctcgccccgatcctggccgaggtcgaaccgcggatcctcaccgtgagcgccgaatacctcgacctcgcagtcgaatccgtgcgggacgtcaactcggtgtcgcagctcgtggtgttcgaccatcaccccgaggtcgacgaccaccgcgacgcactggcccgcgcgcgtgaacaactcgccggcaagggcatcgccgtcaccaccctggacgcgatcgccgacgagggcgccgggctgccggccgaaccgatctacaccgccgaccatgatcagcgcctcgcgatgatcctgtacacctcgggttccaccggcgcacccaagggtgcgatgtacaccgaggcgatggtggcgcggctgtggaccatgtcgttcatcacgggtgaccccacgccggtcatcaacgtcaacttcatgccgctcaaccacctgggcgggcgcatccccatttccaccgccgtgcagaacggtggaaccagttacttcgtaccggaatccgacatgtccacgctgttcgaggatctcgcgctggtgcgcccgaccgaactcggcctggttccgcgcgtcgccgacatgctctaccagcaccacctcgccaccgtcgaccgcctggtcacgcagggcgccgacgaactgaccgccgagaagcaggccggtgccgaactgcgtgagcaggtgctcggcggacgcgtgatcaccggattcgtcagcaccgcaccgctggccgcggagatgagggcgttcctcgacatcaccctgggcgcacacatcgtcgacggctacgggctcaccgagaccggcgccgtgacacgcgacggtgtgatcgtgcggccaccggtgatcgactacaagctgatcgacgttcccgaactcggctacttcagcaccgacaagccctacccgcgtggcgaactgctggtcaggtcgcaaacgctgactcccgggtactacaagcgccccgaggtcaccgcgagcgtcttcgaccgggacggctactaccacaccggcgacgtcatggccgagaccgcacccgaccacctggtgtacgtggaccgtcgcaacaacgtcctcaaactcgcgcagggcgagttcgtggcggtcgccaacctggaggcggtgttctccggcgcggcgctggtgcgccagatcttcgtgtacggcaacagcgagcgcagtttccttctggccgtggtggtcccgacgccggaggcgctcgagcagtacgatccggccgcgctcaaggccgcgctggccgactcgctgcagcgcaccgcacgcgacgccgaactgcaatcctacgaggtgccggccgatttcatcgtcgagaccgagccgttcagcgccgccaacgggctgctgtcgggtgtcggaaaactgctgcggcccaacctcaaagaccgctacgggcagcgcctggagcagatgtacgccgatatcgcggccacgcaggccaaccagttgcgcgaactgcggcgcgcggccgccacacaaccggtgatcgacaccctcacccaggccgctgccacgatcctcggcaccgggagcgaggtggcatccgacgcccacttcaccgacctgggcggggattccctgtcggcgctgacactttcgaacctgctgagcgatttcttcggtttcgaagttcccgtcggcaccatcgtgaacccggccaccaacctcgcccaactcgcccagcacatcgaggcgcagcgcaccgcgggtgaccgcaggccgagtttcaccaccgtgcacggcgcggacgccaccgagatccgggcgagtgagctgaccctggacaagttcatcgacgccgaaacgctccgggccgcaccgggtctgcccaaggtcaccaccgagccacggacggtgttgctctcgggcgccaacggctggctgggccggttcctcacgttgcagtggctggaacgcctggcacctgtcggcggcaccctcatcacgatcgtgcggggccgcgacgacgccgcggcccgcgcacggctgacccaggcctacgacaccgatcccgagttgtcccgccgcttcgccgagctggccgaccgccacctgcgggtggtcgccggtgacatcggcgacccgaatctgggcctcacacccgagatctggcaccggctcgccgccgaggtcgacctggtggtgcatccggcagcgctggtcaaccacgtgctcccctaccggcagctgttcggccccaacgtcgtgggcacggccgaggtgatcaagctggccctcaccgaacggatcaagcccgtcacgtacctgtccaccgtgtcggtggccatggggatccccgacttcgaggaggacggcgacatccggaccgtgagcccggtgcgcccgctcgacggcggatacgccaacggctacggcaacagcaagtgggccggcgaggtgctgctgcgggaggcccacgatctgtgcgggctgcccgtggcgacgttccgctcggacatgatcctggcgcatccgcgctaccgcggtcaggtcaacgtgccagacatgttcacgcgactcctgttgagcctcttgatcaccggcgtcgcgccgcggtcgttctacatcggagacggtgagcgcccgcgggcgcactaccccggcctgacggtcgatttcgtggccgaggcggtcacgacgctcggcgcgcagcagcgcgagggatacgtgtcctacgacgtgatgaacccgcacgacgacgggatctccctggatgtgttcgtggactggctgatccgggcgggccatccgatcgaccgggtcgacgactacgacgactgggtgcgtcggttcgagaccgcgttgaccgcgcttcccgagaagcgccgcgcacagaccgtactgccgctgctgcacgcgttccgcgctccgcaggcaccgttgcgcggcgcacccgaacccacggaggtgttccacgccgcggtgcgcaccgcgaaggtgggcccgggagacatcccgcacctcgacgaggcgctgatcgacaagtacatacgcgatctgcgtgagttcggtctgatctgagaattctagatctgatcgttgcgggcggggcgagagtctcgccccgcccgcgaccgcggtgaaaatacgagaatattatttgtattgatctcctaggcggggtaccgtattttggatgataacgaggcgcaaaaaatggcggacacgttattgattctgggtgatagcctgagcgccgggtatcgaatgtctgccagcgcggcctggcctgccttgttgaatgataagtggcagagtaaaacgtcggtagttaatgccagcatcagcggcgacacctcgcaacaaggactggcgcgccttccggctctgctgaaacagcatcagccgcgttgggtgctggttgaactgggcggcaatgacggtttgcgtggttttcagccacagcaaaccgagcaaacgctgcgccagattttgcaggatgtcaaagccgccaacgctgaaccattgttaatgcaaatacgtctgcctgcaaactatggtcgccgttataatgaagcctttagcgccatttaccccaaactcgccaaagagtttgatgttccgctgctgcccttttttatggaagaggtctacctcaagccacaatggatgcaggatgacggtattcatcccaaccgcgacgcccagccgtttattgccgactggatggcgaagcagttgcagcctttagtaaatcatgactcataacctaggggtaccgctagcgagctctctagagaagcttgggcccgaacaaaaactcatctcagaagaggatctgaatagcgccgtcgaccatcatcatcatcatcattgagtttaaacggtctccagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgacgcctgatgcggtattttctccttacgcatctgtgcggtatttcacaccgcatatggtgcactctcagtacaatctgctctgatgccgcatagttaagccagccccgacacccgccaacacccgctgacgagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcaggggaattaattcccacgggttttgctgcccgcaaacgggctgttctggtgttgctagtttgttatcagaatcgcagatccggcttcagccggtttgccggctgaaagcgctatttcttccagaattgccatgattttttccccacgggaggcgtcactggctcccgtgttgtcggcagctttgattcgataagcagcatcgcctgtttcaggctgtctatgtgtgactgttgagctgtaacaagttgtctcaggtgttcaatttcatgttctagttgctttgttttactggtttcacctgttctattaggtgttacatgctgttcatctgttacattgtcgatctgttcatggtgaacagctttgaatgcaccaaaaactcgtaaaagctctgatgtatctatcttttttacaccgttttcatctgtgcatatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttatgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaat

SEQ ID NO: 214 - DNA, 26 bp, Artificial Sequence
  Description of Artificial Sequence: Synthetic primer
ttttcctaggatgactgaacaaacca

SEQ ID NO: 215 - DNA, 31 bp, Artificial Sequence
  Description of Artificial Sequence: Synthetic primer
ttttgaattcttatcattgtgaaagccagaa

SEQ ID NO: 216 - DNA, 30 bp, Artificial Sequence
  Description of Artificial Sequence: Synthetic primer
ttttgaattctgtaggctggagctgcttcg

SEQ ID NO: 217 - DNA, 20 bp, Artificial Sequence
  Description of Artificial Sequence: Synthetic primer
attccggggatccgtcgacc

SEQ ID NO: 218 - DNA, 25 bp, Artificial Sequence
  Description of Artificial Sequence: Synthetic primer
ttttctagaaatagcgccagcgaca

SEQ ID NO: 219 - DNA, 37 bp, Artificial Sequence
  Description of Artificial Sequence: Synthetic primer
ttttagatcttagccctaggccagtaatcactgcacg

SEQ ID NO: 220 - DNA, 26 bp, Artificial Sequence
  Description of Artificial Sequence: Synthetic primer
ttttagatctagcttcggcttcggcg

SEQ ID NO: 221 - DNA, 29 bp, Artificial Sequence
  Description of Artificial Sequence: Synthetic primer
ttttgcggccgcgcccatcctttgctggc

SEQ ID NO: 222 - DNA, 16 bp, Artificial Sequence
  Description of Artificial Sequence: Synthetic primer
acgacaaatgcgccgc

SEQ ID NO: 223 - DNA, 16 bp, Artificial Sequence
  Description of Artificial Sequence: Synthetic primer
atccgcgcaataaagc

SEQ ID NO: 224 - DNA, 25 bp, Artificial Sequence
  Description of Artificial Sequence: Synthetic primer
atgtctgacaaggggtttgacccct

SEQ ID NO: 225 - DNA, 25 bp, Artificial Sequence
  Description of Artificial Sequence: Synthetic primer
gcacatccttatccaattgctctag

SEQ ID NO: 226 - DNA, 25 bp, Artificial Sequence
  Description of Artificial Sequence: Synthetic primer
gatcaaacaggtgcagcagcaactt

SEQ ID NO: 227 - DNA, 25 bp, Artificial Sequence
  Description of Artificial Sequence: Synthetic primer
attcttgacaagcgatcgcggtcac

SEQ ID NO: 228 - protein, 471 aa, Euglena gracilis
VPQMAEGFSGEATSAWAAAGPQWAAPLVAAASSALALWWWAARRSVRRPLAALAELPTAVTHLAPPMAMFTTTAKVIQPKIRGFICTTTHPIGCEKRVQEEIAYARAHPPTSPGPKRVLVIGCSTGYGLSTRITAAFGYQAATLGVFLAGPPTKGRPAAAGWYNTVAFEKAALEAGLYARSLNGDAFDSTTKARTVEAIKRDLGTVDLVVYSIAAPKRTDPATGVLHKACLKPIGATYTNRTVNTDKAEVTDVSIEPASPEEIADTVKVMGGEDWELWIQALSEAGVLAEGAKTVAYSYIGPEMTWPVYWSGTIGEAKKDVEKAAKRITQQYGCPAYPVVAKALVTQASSAIPVVPLYICLLYRVMKEKGTHEGCIEQMVRLLTTKLYPENGAPIVDEAGRVRVDDWEMAEDVQQAVKDLWSQVSTANLKDISDFAGYQTEFLRLFGFGIDGVDYDQPVDVEADLPSAAQQ

SEQ ID NO: 229 - DNA, 1164 bp, Escherichia coli
atggaacaggttgtcattgtcgatgcaattcgcaccccgatgggccgttcgaagggcggtgcttttcgtaacgtgcgtgcagaagatctctccgctcatttaatgcgtagcctgctggcgcgtaacccggcgctggaagcggcggccctcgacgatatttactggggttgtgtgcagcagacgctggagcagggttttaatatcgcccgtaacgcggcgctgctggcagaagtaccacactctgtcccggcggttaccgttaatcgcttgtgtggttcatccatgcaggcactgcatgacgcagcacgaatgatcatgactggcgatgcgcaggcatgtctggttggcggcgtggagcatatgggccatgtgccgatgagtcacggcgtcgattttcaccccggcctgagccgcaatgtcgccaaagcggcgggcatgatgggcttaacggcagaaatgctggcgcgtatgcacggtatcagccgtgaaatgcaggatgcctttgccgcgcggtcacacgcccgcgcctgggccgccacgcagtcggccgcatttaaaaatgaaatcatcccgaccggtggtcacgatgccgacggcgtcctgaagcagtttaattacgacgaagtgattcgcccggaaaccaccgtggaagccctcgccacgctgcgtccggcgtttgatccagtaaacggtatggtaacggcgggcacatcttctgcactttccgatggcgcagctgccatgctggtgatgagtgaaagccgcgcccatgaattaggtcttaagccgcgcgctcgtgtgcgttcgatggcggtcgttggttgtgacccatcgattatgggttacggcccggttccggcctcgaaactggcgctgaaaaaagcggggctttctgccagcgatatcggcgtgtttgaaatgaacgaagcctttgccgcgcagatcctgccatgtattaaagatctgggactaattgagcagattgacgagaagatcaacctcaacggtggcgcgatcgcgctgggtcatccgctgggttgttccggtgcgcgtatcagcaccacgctgctgaatctgatggaacgcaaagacgttcagtttggtctggcgacgatgtgtatcggtctgggtcagggtattgcgacggtgtttgagcgggtttaa

SEQ ID NO: 230 - protein, 387 aa, Escherichia coli
MEQVVIVDAIRTPMGRSKGGAFRNVRAEDLSAHLMRSLLARNPALEAAALDDIYWGCVQQTLEQGFNIARNAALLAEVPHSVPAVTVNRLCGSSMQALHDAARMIMTGDAQACLVGGVEHMGHVPMSHGVDFHPGLSRNVAKAAGMMGLTAEMLARMHGISREMQDAFAARSHARAWAATQSAAFKNEIIPTGGHDADGVLKQFNYDEVIRPETTVEALATLRPAFDPVNGMVTAGTSSALSDGAAAMLVMSESRAHELGLKPRARVRSMAVVGCDPSIMGYGPVPASKLALKKAGLSASDIGVFEMNEAFAAQILPCIKDLGLIEQIDEKINLNGGAIALGHPLGCSGARISTTLLNLMERKDVQFGLATMCIGLGQGIATVFERV

SEQ ID NO: 231 - DNA, 2190 bp, Escherichia coli
atgctttacaaaggcgacaccctgtaccttgactggctggaagatggcattgccgaactggtatttgatgccccaggttcagttaataaactcgacactgcgaccgtcgccagcctcggcgaggccatcggcgtgctggaacagcaatcagatctaaaagggctgctgctgcgttcgaacaaagcagcctttatcgtcggtgctgatatcaccgaatttttgtccctgttcctcgttcctgaagaacagttaagtcagtggctgcactttgccaatagcgtgtttaatcgcctggaagatctgccggtgccgaccattgctgccgtcaatggctatgcgctgggcggtggctgcgaatgcgtgctggcgaccgattatcgtctggcgacgccggatctgcgcatcggtctgccggaaaccaaactgggcatcatgcctggctttggcggttctgtacgtatgccacgtatgctgggcgctgacagtgcgctggaaatcattgccgccggtaaagatgtcggcgcggatcaggcgctgaaaatcggtctggtggatggcgtagtcaaagcagaaaaactggttgaaggcgcaaaggcggttttacgccaggccattaacggcgacctcgactggaaagcaaaacgtcagccgaagctggaaccactaaaactgagcaagattgaagccaccatgagcttcaccatcgctaaagggatggtcgcacaaacagcggggaaacattatccggcccccatcaccgcagtaaaaaccattgaagctgcggcccgttttggtcgtgaagaagccttaaacctggaaaacaaaagttttgtcccgctggcgcataccaacgaagcccgcgcactggtcggcattttccttaacgatcaatatgtaaaaggcaaagcgaagaaactcaccaaagacgttgaaaccccgaaacaggccgcggtgctgggtgcaggcattatgggcggcggcatcgcttaccagtctgcgtggaaaggcgtgccggttgtcatgaaagatatcaacgacaagtcgttaaccctcggcatgaccgaagccgcgaaactgctgaacaagcagcttgagcgcggcaagatcgatggtctgaaactggctggcgtgatctccacaatccacccaacgctcgactacgccggatttgaccgcgtggatattgtggtagaagcggttgttgaaaacccgaaagtgaaaaaagccgtactggcagaaaccgaacaaaaagtacgccaggataccgtgctggcgtctaacacttcaaccattcctatcagcgaactggccaacgcgctggaacgcccggaaaacttctgcgggatgcacttctttaacccggtccaccgaatgccgttggtagaaattattcgcggcgagaaaagctccgacgaaaccatcgcgaaagttgtcgcctgggcgagcaagatgggcaagacgccgattgtggttaacgactgccccggcttctttgttaaccgcgtgctgttcccgtatttcgccggtttcagccagctgctgcgcgacggcgcggatttccgcaagatcgacaaagtgatggaaaaacagtttggctggccgatgggcccggcatatctgctggacgttgtgggcattgataccgcgcatcacgctcaggctgtcatggcagcaggcttcccgcagcggatgcagaaagattaccgcgatgccatcgacgcgctgtttgatgccaaccgctttggtcagaagaacggcctcggtttctggcgttataaagaagacagcaaaggtaagccgaagaaagaagaagacgccgccgttgaagacctgctggcagaagtgagccagccgaagcgcgatttcagcgaagaagagattatcgcccgcatgatgatcccgatggtcaacgaagtggtgcgctgtctggaggaaggcattatcgccactccggcggaagcggatatggcgctggtctacggcctgggcttccctccgttccacggcggcgcgttccgctggctggacaccctcggtagcgcaaaatacctcgatatggcacagcaatatcagcacctcggcccgctgtatgaagtgccggaaggtctgcgtaataaagcgcgtcataacgaaccgtactatcctccggttgagccagcccgtccggttggcgacctgaaaacggcttaa

SEQ ID NO: 232 - protein, 729 aa, Escherichia coli
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 233 - DNA, 1311 bp, Escherichia coli
atgggtcaggttttaccgctggttacccgccagggcgatcgtatcgccattgttagcggtttacgtacgccttttgcccgtcaggcgacggcttttcatggcattcccgcggttgatttagggaagatggtggtaggcgaactgctggcacgcagcgagatccccgccgaagtgattgaacaactggtctttggtcaggtcgtacaaatgcctgaagcccccaacattgcgcgtgaaattgttctcggtacgggaatgaatgtacataccgatgcttacagcgtcagccgcgcttgcgctaccagtttccaggcagttgcaaacgtcgcagaaagcctgatggcgggaactattcgagcggggattgccggtggggcagattcctcttcggtattgccaattggcgtcagtaaaaaactggcgcgcgtgctggttgatgtcaacaaagctcgtaccatgagccagcgactgaaactcttctctcgcctgcgtttgcgcgacttaatgcccgtaccacctgcggtagcagaatattctaccggcttgcggatgggcgacaccgcagagcaaatggcgaaaacctacggcatcacccgagaacagcaagatgcattagcgcaccgttcgcatcagcgtgccgctcaggcatggtcagacggaaaactcaaagaagaggtgatgactgcctttatccctccttataaacaaccgcttgtcgaagacaacaatattcgcggtaattcctcgcttgccgattacgcaaagctgcgcccggcgtttgatcgcaaacacggaacggtaacggcggcaaacagtacgccgctgaccgatggcgcggcagcggtgatcctgatgactgaatcccgggcgaaagaattagggctggtgccgctggggtatctgcgcagctacgcatttactgcgattgatgtctggcaggacatgttgctcggtccagcctggtcaacaccgctggcgctggagcgtgccggtttgacgatgagcgatctgacattgatcgatatgcacgaagcctttgcagctcagacgctggcgaatattcagttgctgggtagtgaacgttttgctcgtgaagcactggggcgtgcacatgccactggcgaagtggacgatagcaaatttaacgtgcttggcggttcgattgcttacgggcatcccttcgcggcgaccggcgcgcggatgattacccagacattgcatgaacttcgccgtcgcggcggtggatttggtttagttaccgcctgtgctgccggtgggcttggcgcggcaatggttctggaggcggaataa

SEQ ID NO: 234 - protein, 436 aa, Escherichia coli
MGQVLPLVTRQGDRIAIVSGLRTPFARQATAFHGIPAVDLGKMVVGELLARSEIPAEVIEQLVFGQVVQMPEAPNIAREIVLGTGMNVHTDAYSVSRACATSFQAVANVAESLMAGTIRAGIAGGADSSSVLPIGVSKKLARVLVDVNKARTMSQRLKLFSRLRLRDLMPVPPAVAEYSTGLRMGDTAEQMAKTYGITREQQDALAHRSHQRAAQAWSDGKLKEEVMTAFIPPYKQPLVEDNNIRGNSSLADYAKLRPAFDRKHGTVTAANSTPLTDGAAAVILMTESRAKELGLVPLGYLRSYAFTAIDVWQDMLLGPAWSTPLALERAGLTMSDLTLIDMHEAFAAQTLANIQLLGSERFAREALGRAHATGEVDDSKFNVLGGSIAYGHPFAATGARMITQTLHELRRRGGGFGLVTACAAGGLGAAMVLEAE

SEQ ID NO: 235 - DNA, 2145 bp, Escherichia coli
atggaaatgacatcagcgtttacccttaatgttcgtctggacaacattgccgttatcaccatcgacgtaccgggtgagaaaatgaataccctgaaggcggagtttgcctcgcaggtgcgcgccattattaagcaactccgtgaaaacaaagagttgcgaggcgtggtgtttgtctccgctaaaccggacaacttcattgctggcgcagacatcaacatgatcggcaactgcaaaacggcgcaagaagcggaagctctggcgcggcagggccaacagttgatggcggagattcatgctttgcccattcaggttatcgcggctattcatggcgcttgcctgggtggtgggctggagttggcgctggcgtgccacggtcgcgtttgtactgacgatcctaaaacggtgctcggtttgcctgaagtacaacttggattgttacccggttcaggcggcacccagcgtttaccgcgtctgataggcgtcagcacagcattagagatgatcctcaccggaaaacaacttcgggcgaaacaggcattaaagctggggctggtggatgacgttgttccgcactccattctgctggaagccgctgttgagctggcaaagaaggagcgcccatcttcccgccctctacctgtacgcgagcgtattctggcggggccgttaggtcgtgcgctgctgttcaaaatggtcggcaagaaaacagaacacaaaactcaaggcaattatccggcgacagaacgcatcctggaggttgttgaaacgggattagcgcagggcaccagcagcggttatgacgccgaagctcgggcgtttggcgaactggcgatgacgccacaatcgcaggcgctgcgtagtatcttttttgccagtacggacgtgaagaaagatcccggcagtgatgcgccgcctgcgccattaaacagcgtggggattttaggtggtggcttgatgggcggcggtattgcttatgtcactgcttgtaaagcggggattccggtcagaattaaagatatcaacccgcagggcataaatcatgcgctgaagtacagttgggatcagctggagggcaaagttcgccgtcgtcatctcaaagccagcgaacgtgacaaacagctggcattaatctccggaacgacggactatcgcggctttgcccatcgcgatctgattattgaagcggtgtttgaaaatctcgaattgaaacaacagatggtggcggaagttgagcaaaattgcgccgctcataccatctttgcttcgaatacgtcatctttaccgattggtgatatcgccgctcacgccacgcgacctgagcaagttatcggcctgcatttcttcagtccggtggaaaaaatgccgctggtggagattattcctcatgcggggacatcggcgcaaaccatcgctaccacagtaaaactggcgaaaaaacagggtaaaacgccaattgtcgtgcgtgacaaagccggtttttacgtcaatcgcatcttagcgccttacattaatgaagctatccgcatgttgacccaaggtgaacgggtagagcacattgatgccgcgctagtgaaatttggttttccggtaggcccaatccaacttttggatgaggtaggaatcgacaccgggactaaaattattcctgtactggaagccgcttatggagaacgttttagcgcgcctgcaaatgttgtttcttcaattttgaacgacgatcgcaaaggcagaaaaaatggccggggtttctatctttatggtcagaaagggcgtaaaagcaaaaaacaggtcgatcccgccatttacccgctgattggcacacaagggcaggggcgaatctccgcaccgcaggttgctgaacggtgtgtgatgttgatgctgaatgaagcagtacgttgtgttgatgagcaggttatccgtagcgtgcgtgacggggatattggcgcggtatttggcattggttttccgccatttctcggtggaccgttccgctatatcgattctctcggcgcgggcgaagtggttgcaataatgcaacgacttgccacgcagtatggttcccgttttaccccttgcgagcgtttggtcgagatgggcgcgcgtggggaaagtttttggaaaacaactgcaactgacctgcaataa

SEQ ID NO: 236 - protein, 714 aa, Escherichia coli
MEMTSAFTLNVRLDNIAVITIDVPGEKMNTLKAEFASQVRAIIKQLRENKELRGVVFVSAKPDNFIAGADINMIGNCKTAQEAEALARQGQQLMAEIHALPIQVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKKERPSSRPLPVRERILAGPLGRALLFKMVGKKTEHKTQGNYPATERILEVVETGLAQGTSSGYDAEARAFGELAMTPQSQALRSIFFASTDVKKDPGSDAPPAPLNSVGILGGGLMGGGIAYVTACKAGIPVRIKDINPQGINHALKYSWDQLEGKVRRRHLKASERDKQLALISGTTDYRGFAHRDLIIEAVFENLELKQQMVAEVEQNCAAHTIFASNTSSLPIGDIAAHATRPEQVIGLHFFSPVEKMPLVEIIPHAGTSAQTIATTVKLAKKQGKTPIVVRDKAGFYVNRILAPYINEAIRMLTQGERVEHIDAALVKFGFPVGPIQLLDEVGIDTGTKIIPVLEAAYGERFSAPANVVSSILNDDRKGRKNGRGFYLYGQKGRKSKKQVDPAIYPLIGTQGQGRISAPQVAERCVMLMLNEAVRCVDEQVIRSVRDGDIGAVFGIGFPPFLGGPFRYIDSLGAGEVVAIMQRLATQYGSRFTPCERLVEMGARGESFWKTTATDLQ

SEQ ID NO: 237 - DNA, 789 bp, Escherichia coli; identical to SEQ ID NO: 191

SEQ ID NO: 238 - protein, 262 aa, Escherichia coli; identical to SEQ ID NO: 192

SEQ ID NO: 239 - DNA, 861 bp, Escherichia coli
atgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 240 - protein, 286 aa, Escherichia coli
MSQALKNLLTLLNLEKIEEGLFRGQSEDLGLRQVFGGQVVGQALYAAKETVPEERLVHSFHSYFLRPGDSKKPIIYDVETLRDGNSFSARRVAAIQNGKPIFYMTASFQAPEAGFEHQKTMPSAPAPDGLPSETQIAQSLAHLLPPVLKDKFICDRPLEVRPVEFHNPLKGHVAEPHRQVWIRANGSVPDDLRVHQYLLGYASDLNFLPVALQPHGIGFLEPGIQIATIDHSMWFHRPFNLNEWLLYSVESTSASSARGFVRGEFYTQDGVLVASTVQEGVMRNHN

SEQ ID NO: 241 - DNA, 912 bp, Acinetobacter sp.
ttgatatcaatcagggaaaaacgcgtgaacaaaaaacttgaagctctcttccgagagaatgtaaaaggtaaagtggctttgatcactggtgcatctagtggaatcggtttgacgattgcaaaaagaattgctgcggcaggtgctcatgtattattggttgcccgaacccaagaaacactggaagaagtgaaagctgcaattgaacagcaagggggacaggcctctatttttccttgtgacctgactgacatgaatgcgattgaccagttatcacaacaaattatggccagtgtcgatcatgtcgatttcctgatcaataatgcagggcgttcgattcgccgtgccgtacacgagtcgtttgatcgcttccatgattttgaacgcaccatgcagctgaattactttggtgcggtacgtttagtgttaaatttactgccacatatgattaagcgtaaaaatggccagatcatcaatatcagctctattggtgtattggccaatgcgacccgtttttctgcttatgtcgcgtctaaagctgcgctggatgccttcagtcgctgtctttcagccgaggtactcaagcataaaatctcaattacctcgatttatatgccattggtgcgtaccccaatgatcgcacccaccaaaatttataaatacgtgcccacgctttccccagaagaagccgcagatctcattgtctacgccattgtgaaacgtccaaaacgtattgcgacgcacttgggtcgtctggcgtcaattacctatgccatcgcaccagacatcaataatattctgatgtcgattggatttaacctattcccaagctcaacggctgcactgggtgaacaggaaaaattgaatctgctacaacgtgcctatgcccgcttgttcccaggcgaacactggtaa

SEQ ID NO: 242 - protein, 303 aa, Acinetobacter sp.
MISIREKRVNKKLEALFRENVKGKVALITGASSGIGLTIAKRIAAAGAHVLLVARTQETLEEVKAAIEQQGGQASIFPCDLTDMNAIDQLSQQIMASVDHVDFLINNAGRSIRRAVHESFDRFHDFERTMQLNYFGAVRLVLNLLPHMIKRKNGQIINISSIGVLANATRFSAYVASKAALDAFSRCLSAEVLKHKISITSIYMPLVRTPMIAPTKIYKYVPTLSPEEAADLIVYAIVKRPKRIATHLGRLASITYAIAPDINNILMSIGFNLFPSSTAALGEQEKLNLLQRAYARLFPGEHW

SEQ ID NO: 243 - DNA, 519 bp, Escherichia coli
atggtagataaacgcgaatcctatacaaaagaagaccttcttgcctctggtcgcggtgaactgtttggcgctaaaggcccgcaattgccagcaccgaacatgctgatgatggaccgtgtggtcaaaatgaccgaaacgggtggtaacttcgacaaagggtatgttgaagcagaactggatatcaatccggatctgtggttcttcggatgccactttattggcgatccggttatgccgggatgcctgggcctggacgcaatgtggcagctggtagggttctacctcggctggctgggcggcgaaggtaaaggccgcgcgctgggcgttggcgaagtgaaattcactggtcaggtactgccgacagcgaaaaaagtgacctaccgtattcactttaaacgcattgttaaccgtcgtctgattatgggcctggcggatggcgaagtgctggttgatggtcgtctgatctataccgccagcgacctgaaagtcggtctgttccaggatacgtctgccttctga

SEQ ID NO: 244 - protein, 172 aa, Escherichia coli
MVDKRESYTKEDLLASGRGELFGAKGPQLPAPNMLMMDRVVKMTETGGNFDKGYVEAELDINPDLWFFGCHFIGDPVMPGCLGLDAMWQLVGFYLGWLGGEGKGRALGVGEVKFTGQVLPTAKKVTYRIHFKRIVNRRLIMGLADGEVLVDGRLIYTASDLKVGLFQDTSAF

SEQ ID NO: 245 - DNA, 456 bp, Escherichia coli
ttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgatggtaaagtagtttgcgaagcaacgatgatgtgtgctcgtagccgggaggcctga

SEQ ID NO: 246 - protein, 151 aa, Escherichia coli
MTTNTHTLQIEEILELLPHRFPFLLVDRVLDFEEGRFLRAVKNVSVNEPFFQGHFPGKPIFPGVLILEAMAQATGILAFKSVGKLEPGELYYFAGIDEARFKRPVVPGDQMIMEVTFEKTRRGLTRFKGVALVDGKVVCEATMMCARSREA

SEQ ID NO: 247 - DNA, 912 bp, Escherichia coli
gtgagtacattagaacaaacaataggcaatacgcctctggtgaagttgcagcgaatggggccggataacggcagtgaagtgtggttaaaactggaaggcaataacccggcaggttcggtgaaagatcgtgcggcactttcgatgatcgtcgaggcggaaaagcgcggggaaattaaaccgggtgatgtcttaatcgaagccaccagtggtaacaccggcattgcgctggcaatgattgccgcgctgaaaggctatcgcatgaaattgctgatgcccgacaacatgagccaggaacgccgtgcggcgatgcgtgcttatggtgcggaactgattcttgtcaccaaagagcagggcatggaaggtgcgcgcgatctggcgctggagatggcgaatcgtggcgaaggaaagctgctcgatcagttcaataatcccgataacccttatgcgcattacaccaccactgggccggaaatctggcagcaaaccggcgggcgcatcactcattttgtctccagcatggggacgaccggcactatcaccggcgtctcacgctttatgcgcgaacaatccaaaccggtgaccattgtcggcctgcaaccggaagagggcagcagcattcccggcattcgccgctggcctacggaatatctgccggggattttcaacgcttctctggtggatgaggtgctggatattcatcagcgcgatgcggaaaacaccatgcgcgaactggcggtgcgggaaggaatattctgtggcgtcagctccggcggcgcggttgccggagcactgcgggtggcaaaagctaaccctgacgcggtggtggtggcgatcatctgcgatcgtggcgatcgctacctttctaccggggtgtttggggaagagcattttagccagggggcggggatttaa

SEQ ID NO: 248 - protein, 303 aa, Escherichia coli
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 249 - DNA, 2046 bp, Escherichia coli
atgcagcagttagccagtttcttatccggtacctggcagtctggccggggccgtagccgtttgattcaccacgctattagcggcgaggcgttatgggaagtgaccagtgaaggtcttgatatggcggctgcccgccagtttgccattgaaaaaggtgcccccgcccttcgcgctatgacctttatcgaacgtgcggcgatgcttaaagcggtcgctaaacatctgctgagtgaaaaagagcgtttctatgctctttctgcgcaaacaggcgcaacgcgggcagacagttgggttgatattgaaggtggcattgggacgttatttacttacgccagcctcggtagccgggagctgcctgacgatacgctgtggccggaagatgaattgatccccttatcgaaagaaggtggatttgccgcgcgccatttactgacctcaaagtcaggcgtggcagtgcatattaacgcctttaacttcccctgctggggaatgctggaaaagctggcaccaacgtggctgggcggaatgccagccatcatcaaaccagctaccgcgacggcccaactgactcaggcgatggtgaaatcaattgtcgatagtggtcttgttcccgaaggcgcaattagtctgatctgcggtagtgctggcgacttgttggatcatctggacagccaggatgtggtgactttcacggggtcagcggcgaccggacagatgctgcgagttcagccaaatatcgtcgccaaatctatccccttcactatggaagctgattccctgaactgctgcgtactgggcgaagatgtcaccccggatcaaccggagtttgcgctgtttattcgtgaagttgtgcgtgagatgaccacaaaagccgggcaaaaatgtacggcaatccggcggattattgtgccgcaggcattggttaatgctgtcagtgatgctctggttgcgcgattacagaaagtcgtggtcggtgatcctgctcaggaaggcgtgaaaatgggcgcactggtaaatgctgagcagcgtgccgatgtgcaggaaaaagtgaacatattgctggctgcaggatgcgagattcgcctcggtggtcaggcggatttatctgctgcgggtgccttcttcccgccaaccttattgtactgtccgcagccggatgaaacaccggcggtacatgcaacagaagcctttggccctgtcgcaacgctgatgccagcacaaaaccagcgacatgctctgcaactggcttgtgcaggcggcggtagccttgcgggaacgctggtgacggctgatccgcaaattgcgcgtcagtttattgccgacgcggcacgtacgcatgggcgaattcagatcctcaatgaagagtcggcaaaagaatccaccgggcatggctccccactgccacaactggtacatggtgggcctggtcgcgcaggaggcggtgaagaattaggcggtttacgagcggtgaaacattacatgcagcgaaccgctgttcagggtagtccgacgatgcttgccgctatcagtaaacagtgggtgcgcggtgcgaaagtcgaagaagatcgtattcatccgttccgcaaatattttgaggagctacaaccaggcgacagcctgttgactccccgccgcacaatgacagaggccgatattgttaactttgcttgcctcagcggcgatcatttctatgcacatatggataagattgctgctgccgaatctattttcggtgagcgggtggtgcatgggtattttgtgctttctgcggctgcgggtctgtttgtcgatgccggtgtcggtccggtcattgctaactacgggctggaaagcttgcgttttatcgaacccgtaaagccaggcgataccatccaggtgcgtctcacctgtaagcgcaagacgctgaaaaaacagcgtagcgcagaagaaaaaccaacaggtgtggtggaatgggctgtagaggtattcaatcagcatcaaaccccggtggcgctgtattcaattctgacgctggtggccaggcagcacggtgattttgtcgattaa

SEQ ID NO: 250 - protein, 681 aa, Escherichia coli
MQQLASFLSGTWQSGRGRSRLIHHAISGEALWEVTSEGLDMAAARQFAIEKGAPALRAMTFIERAAMLKAVAKHLLSEKERFYALSAQTGATRADSWVDIEGGIGTLFTYASLGSRELPDDTLWPEDELIPLSKEGGFAARHLLTSKSGVAVHINAFNFPCWGMLEKLAPTWLGGMPAIIKPATATAQLTQAMVKSIVDSGLVPEGAISLICGSAGDLLDHLDSQDVVTFTGSAATGQMLRVQPNIVAKSIPFTMEADSLNCCVLGEDVTPDQPEFALFIREVVREMTTKAGQKCTAIRRIIVPQALVNAVSDALVARLQKVVVGDPAQEGVKMGALVNAEQRADVQEKVNILLAAGCEIRLGGQADLSAAGAFFPPTLLYCPQPDETPAVHATEAFGPVATLMPAQNQRHALQLACAGGGSLAGTLVTADPQIARQFIADAARTHGRIQILNEESAKESTGHGSPLPQLVHGGPGRAGGGEELGGLRAVKHYMQRTAVQGSPTMLAAISKQWVRGAKVEEDRIHPFRKYFEELQPGDSLLTPRRTMTEADIVNFACLSGDHFYAHMDKIAAAESIFGERVVHGYFVLSAAAGLFVDAGVGPVIANYGLESLRFIEPVKPGDTIQVRLTCKRKTLKKQRSAEEKPTGVVEWAVEVFNQHQTPVALYSILTLVARQHGDFVD

SEQ ID NO: 251 - DNA, 1221 bp, Escherichia coli
atgaaacgtgcagtgattactggcctgggcattgtttccagcatcggtaataaccagcaggaagtcctggcatctctgcgtgaaggacgttcagggatcactttctctcaggagctgaaggattccggcatgcgtagccacgtctggggcaacgtaaaactggataccactggcctcattgaccgcaaagttgtgcgctttatgagcgacgcatccatttatgcattcctttctatggagcaggcaatcgctgatgcgggcctctctccggaagcttaccagaataacccgcgcgttggcctgattgcaggttccggcggcggctccccgcgtttccaggtgttcggcgctgacgcaatgcgcggcccgcgcggcctgaaagcggttggcccgtatgtggtcaccaaagcgatggcatccggcgtttctgcctgcctcgccaccccgtttaaaattcatggcgttaactactccatcagctccgcgtgtgcgacttccgcacactgtatcggtaacgcagtagagcagatccaactgggcaaacaggacatcgtgtttgctggcggcggcgaagagctgtgctgggaaatggcttgcgaattcgacgcaatgggtgcgctgtctactaaatacaacgacaccccggaaaaagcctcccgtacttacgacgctcaccgtgacggtttcgttatcgctggcggcggcggtatggtagtggttgaagagctggaacacgcgctggcgcgtggtgctcacatctatgctgaaatcgttggctacggcgcaacctctgatggtgcagacatggttgctccgtctggcgaaggcgcagtacgctgcatgaagatggcgatgcatggcgttgataccccaatcgattacctgaactcccacggtacttcgactccggttggcgacgtgaaagagctggcagctatccgtgaagtgttcggcgataagagcccggcgatttctgcaaccaaagccatgaccggtcactctctgggcgctgctggcgtacaggaagctatctactctctgctgatgctggaacacggctttatcgccccgagcatcaacattgaagagctggacgagcaggctgcgggtctgaacatcgtgaccgaaacgaccgatcgcgaactgaccaccgttatgtctaacagcttcggcttcggcggcaccaacgccacgctggtaatgcgcaagctgaaagattaa

SEQ ID NO: 252 - protein, 406 aa, Escherichia coli
MKRAVITGLGIVSSIGNNQQEVLASLREGRSGITFSQELKDSGMRSHVWGNVKLDTTGLIDRKVVRFMSDASIYAFLSMEQAIADAGLSPEAYQNNPRVGLIAGSGGGSPRFQVFGADAMRGPRGLKAVGPYVVTKAMASGVSACLATPFKIHGVNYSISSACATSAHCIGNAVEQIQLGKQDIVFAGGGEELCWEMACEFDAMGALSTKYNDTPEKASRTYDAHRDGFVIAGGGGMVVVEELEHALARGAHIYAEIVGYGATSDGADMVAPSGEGAVRCMKMAMHGVDTPIDYLNSHGTSTPVGDVKELAAIREVFGDKSPAISATKAMTGHSLGAAGVQEAIYSLLMLEHGFIAPSINIEELDEQAAGLNIVTETTDRELTTVMSNSFGFGGTNATLVMRKLKD

SEQ ID NO: 253 - DNA, 1242 bp, Escherichia coli
gtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaa

SEQ ID NO: 254 - protein, 413 aa, Escherichia coli
MSKRRVVVTGLGMLSPVGNTVESTWKALLAGQSGISLIDHFDTSAYATKFAGLVKDFNCEDIISRKEQRKMDAFIQYGIVAGVQAMQDSGLEITEENATRIGAAIGSGIGGLGLIEENHTSLMNGGPRKISPFFVPSTIVNMVAGHLTIMYGLRGPSISIATACTSGVHNIGHAARIIAYGDADVMVAGGAEKASTPLGVGGFGAARALSTRNDNPQAASRPWDKERDGFVLGDGAGMLVLEEYEHAKKRGAKIYAELVGFGMSSDAYHMTSPPENGAGAALAMANALRDAGIEASQIGYVNAHGTSTPAGDKAEAQAVKTIFGEAASRVLVSSTKSMTGHLLGAAGAVESIYSILALRDQAVPPTINLDNPDEGCDLDFVPHEARQVSGMEYTLCNSFGFGGTNGSLIFKKI

SEQ ID NO: 255 - DNA, 2145 bp, Escherichia coli; identical to SEQ ID NO: 235

SEQ ID NO: 256 - protein, 714 aa, Escherichia coli; identical to SEQ ID NO: 236

SEQ ID NO: 257 - DNA, 897 bp, Escherichia coli
atgaccgatttacacaccgatgtagaacgctacctacgttatctgagcgtggagcgccagcttagcccgataaccctgcttaactaccagcgtcagcttgaggcgatcatcaattttgccagcgaaaacggcctgcaaagctggcagcaatgtgatgtgacgatggtgcgcaattttgctgtacgcagtcgccgtaaagggctgggagcagcaagtctggcgttacggctttctgcgctacgtagcttttttgactggctggtcagccagaacgaactcaaagctaacccggcgaaaggtgtttcggcaccgaaagcgccgcgtcatctgccgaaaaacatcgacgtcgacgatatgaatcggctgctggatattgatatcaatgatcccctcgctgtacgcgaccgtgcaatgctggaagtgatgtacggcgcgggtctgcgtctttctgagctggtggggctggatattaaacacctcgacctggagtctggtgaagtgtgggttatggggaaaggcagcaaagagcgccgcctgccgattggtcgcaacgctgtggcgtggattgagcactggcttgatttgcgcgacctgtttggtagcgaagacgacgcgctttttctgtcgaaactgggcaagcgtatctccgcgcgtaatgtgcagaaacgctttgccgaatggggcataaaacaagggctgaataatcacgttcatccgcataaattacgtcactcgttcgccacgcatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataa

SEQ ID NO: 258 - protein, 298 aa, Escherichia coli
MTDLHTDVERYLRYLSVERQLSPITLLNYQRQLEAIINFASENGLQSWQQCDVTMVRNFAVRSRRKGLGAASLALRLSALRSFFDWLVSQNELKANPAKGVSAPKAPRHLPKNIDVDDMNRLLDIDINDPLAVRDRAMLEVMYGAGLRLSELVGLDIKHLDLESGEVWVMGKGSKERRLPIGRNAVAWIEHWLDLRDLFGSEDDALFLSKLGKRISARNVQKRFAEWGIKQGLNNHVHPHKLRHSFATHMLESSGDLRGVQELLGHANLSTTQIYTHLDFQHLASVYDAAHPRAKRGK

SEQ ID NO: 259 - DNA, 1182 bp, Escherichia coli
atgaaagacgttgtgattgtcggggcgttacggacacctatcggctgctttcgtggtgcgttagcgggtcattccgccgtggaacttggtagtctggtcgtgaaagcgttaatagaacgtaccggcgttcctgcatatgcggtggatgaagtaattcttggtcaggtgttgactgcaggggcagggcagaatccggcaaggcaatcggctattaaaggtggtctgcctaatagcgtttctgcaatcactattaatgacgtttgcggttccgggcttaaagcactgcatctggctactcaggcgatacagtgtggcgaggctgatattgtcatcgccggtggccaggaaaacatgagccgcgcaccacatgttctgactgatagccgcaccggtgcacagcttggcaatagccagttggttgacagtcttgtgcatgatgggttgtgggatgccttcaatgattatcatattggtgtcaccgccgaaaatctggctcgcgaatatggcatcagccgtcagttgcaggatgcttacgcacttagctcgcaacaaaaagcgcgagcggcgattgacgccggacgatttaaagatgagatcgtcccggtaatgacccaaagtaacgggcagacgttggttgttgataccgatgaacagccacgcactgacgccagcgcagaaggcttagcccgtttaaatccttcatttgatagtctcggttctgtgacagcgggtaatgcatcatccataaacgatggcgcagctgcggtaatgatgatgagcgaagccaaagcacgagcgttgaatttacccgtgctggcccgcattcgcgcatttgccagcgttggtgtagatccggcattgatgggaattgcgccggtgtatgcgacccgccgttgcctggagcgtgtaggctggcagttggctgaagtcgatcttatcgaggctaatgaagcgtttgctgcacaggcgctttcggttggcaagatgcttgagtgggatgagcgtcgggtcaatgtcaatggtggcgcgatcgcactcggtcacccgataggcgcttccggttgccgaatcctggtttctctggttcatgaaatggtgaaacgtaatgcccgcaaaggactggcaacgctttgtatcggcgggggccagggtgtggcattgaccattgaacgtgacgaatag

SEQ ID NO: 260 - protein, 393 aa, Escherichia coli
MKDVVIVGALRTPIGCFRGALAGHSAVELGSLVVKALIERTGVPAYAVDEVILGQVLTAGAGQNPARQSAIKGGLPNSVSAITINDVCGSGLKALHLATQAIQCGEADIVIAGGQENMSRAPHVLTDSRTGAQLGNSQLVDSLVHDGLWDAFNDYHIGVTAENLAREYGISRQLQDAYALSSQQKARAAIDAGRFKDEIVPVMTQSNGQTLVVDTDEQPRTDASAEGLARLNPSFDSLGSVTAGNASSINDGAAAVMMMSEAKARALNLPVLARIRAFASVGVDPALMGIAPVYATRRCLERVGWQLAEVDLIEANEAFAAQALSVGKMLEWDERRVNVNGGAIALGHPIGASGCRILVSLVHEMVKRNARKGLATLCIGGGQGVALTIERDE

SEQ ID NO: 261 - DNA, 897 bp, Escherichia coli
atgcaatttgaaaagatgattactgaaggctcgaacaccgcctcggctgaaattgaccgcgtatcgacgctggaaatgtgccggattatcaacgatgaagataaaaccgtaccgcttgccgttgagcgcgtactgccggatatcgccgcggcgatcgatgttatccacgcccaggtaagcggcggcgggcgtctgatttacctcggtgcgggaacatccggtcgtctggggattctggatgccagcgaatgtccgcccacctacggcgtgaaaccgggtctggtggttggtttgattgctggcggcgaatatgccattcagcacgcggtggaaggcgcggaagatagccgggaaggcggtgttaatgatctgaaaaatattaatttaacggcacaggatgtggtggttggcattgctgccagcggtcgcacgccgtatgtgattgccggactggaatacgcacgccagctcggctgccgcacagtgggaatttcctgtaatccggggagcgccgtttcaaccaccgctgagtttgccattacaccgattgtaggtgccgaagttgttaccggttcttcgcggatgaaagcaggtacagcgcagaaactggtgctcaatatgctttccaccgggctgatgattaaatccggcaaagtgttcggcaacctgatggtcgatgtggtcgccaccaacgaaaaactgcatgtgcgacaggtcaatattgttaaaaacgccaccggatgtagcgcagagcaagcggaagcggcgttaattgcttgcgagcgcaactgtaaaacggccattgtgatggtgctgaaaaatctcgatgccgcagaagctaaaaaacgcctggatcaacacggcggctttattcgtcaggttttagacaaggaataa

SEQ ID NO: 262 - protein, 298 aa, Escherichia coli
MQFEKMITEGSNTASAEIDRVSTLEMCRIINDEDKTVPLAVERVLPDIAAAIDVIHAQVSGGGRLIYLGAGTSGRLGILDASECPPTYGVKPGLVVGLIAGGEYAIQHAVEGAEDSREGGVNDLKNINLTAQDVVVGIAASGRTPYVIAGLEYARQLGCRTVGISCNPGSAVSTTAEFAITPIVGAEVVTGSSRMKAGTAQKLVLNMLSTGLMIKSGKVFGNLMVDVVATNEKLHVRQVNIVKNATGCSAEQAEAALIACERNCKTAIVMVLKNLDAAEAKKRLDQHGGFIRQVLDKE

SEQ ID NO: 263 - DNA, 3507 bp, Mycobacterium tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgacttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 264 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLTYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 265 - DNA, 3282 bp, Mycobacterium tuberculosis
atggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 266 - protein, 1093 aa, Mycobacterium tuberculosis
MVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 267 - DNA, 3126 bp, Mycobacterium tuberculosis
gacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 268 - protein, 1041 aa, Mycobacterium tuberculosis
DIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 269 - DNA, 3000 bp, Mycobacterium tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctgggccgacaccagctataccggtcagctcaacctgccggacatgtcacccgggctgatgctgagcctggc

SEQ ID NO: 270 - protein, 1000 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILGRHQLYRSAQPAGHVTRADAEPG

SEQ ID NO: 271 - DNA, 3525 bp, Mycobacterium intracellulare; identical to SEQ ID NO: 33

SEQ ID NO: 272 - protein, 1174 aa, Mycobacterium intracellulare; identical to SEQ ID NO: 34

The invention claimed is:

1. A bacterial cell culture comprising:
    (a) a bacterial cell genetically engineered to express an exogenous polypeptide having the amino acid sequence of SEQ ID NO:22, and
    (b) a glycerol-containing carbon source,
    wherein a fatty alcohol composition comprising C12 and C14 fatty alcohols is produced by the genetically engineered bacterial cell.

2. The cell culture of claim 1, wherein the bacterial cell is further engineered to express an exogenous polypeptide having thioesterase (EC 3.1.2.14 or EC 3.1.1.5) activity effective to release a fatty acid from acyl-ACP.

3. The cell culture of claim 1, wherein acyl-CoA dehydrogenase (fadE; EC 1.3.99.3, 1.3.99.) expression or activity is attenuated in the bacterial cell as compared to a wild-type bacterial cell.

4. The cell culture of claim 1, wherein acyl-CoA dehydrogenase (YdiO; EC 1.3.99.) expression or activity is deleted or reduced in the bacterial cell as compared to a wild-type bacterial cell.

5. The cell culture of claim 1, wherein 3-ketoacyl-CoA thiolase (fadA; EC 2.3.1.16) expression or activity is deleted or reduced in the bacterial cell as compared to a wild-type bacterial cell.

6. The cell culture of claim 1, wherein fadB (EC 4.2.1.17, EC 5.1.2.3, EC 5.3.3.8, EC 1.1.1.35) expression or activity is deleted or reduced in the bacterial cell as compared to a wild-type bacterial cell.

7. The cell culture of claim 1, wherein beta-ketoacyl-CoA thiolase (fadl; EC 2.3.1.16) expression or activity is deleted or reduced in the bacterial cell as compared to a wild-type bacterial cell.

8. The cell culture of claim 1, wherein fadJ (EC 5.1.2.3, EC 4.2.1.17, EC 1.1.1.35) expression or activity is deleted or reduced in the bacterial cell as compared to a wild-type bacterial cell.

9. A bacterial cell genetically engineered to express
    (a) an exogenous polypeptide having the amino acid sequence of SEQ ID NO:22,
    (b) a polypeptide having thioesterase (EC 3.1.2.14 or EC 3.1.1.5) activity, and
    (c) a polypeptide having attenuated acyl-CoA dehydrogenase (fadE; EC 1.3.99.3, EC 1.3.99.) activity,
    wherein the genetically engineered bacterial cell produces a fatty alcohol composition comprising C12 and C14 fatty alcohols when cultured in the presence of a glycerol-containing carbon source.

10. A method of making a fatty alcohol composition, comprising:
    a. culturing a bacterial cell genetically engineered to express an exogenous polypeptide having the amino acid sequence of SEQ ID NO:22 in a culture medium comprising glycerol;
    b. fermenting the genetically engineered bacterial cell of part a in a fermentation media, wherein a fatty alcohol composition comprising C12 and C14 fatty alcohols is produced by the genetically engineered bacterial cell; and
    c. optionally separating the fatty alcohol composition from the fermentation media.

11. The method of claim 10, wherein the genetically engineered bacterial cell is further engineered to express an exogenous polynucleotide sequence encoding a polypeptide having thioesterase (EC 3.1.2.14 or EC 3.1.1.5) activity effective to release a fatty acid from acyl-ACP.

12. The method of claim 10, wherein the culture medium further comprises a fatty acid.

13. The method of claim 10, wherein, acyl-CoA dehydrogenase (fadE; EC 1.3.99.3, 1.3.99.) expression or activity is attenuated in the genetically engineered bacterial cell as compared to a wild-type bacterial cell.

14. The method of claim 10, wherein acyl-CoA dehydrogenase (YdiO; EC 1.3.99.) expression or activity is deleted or reduced in the genetically engineered bacterial cell as compared to a wild-type bacterial cell.

15. The method of claim 10, wherein 3-ketoacyl-CoA thiolase (fadA; EC 2.3.1.16) expression or activity is deleted or reduced in the genetically engineered bacterial cell as compared to a wild-type bacterial cell.

16. The method of claim 10, wherein fadB (EC 4.2.1.17, 5.1.2.3, 5.3.3.8, 1.1.1.35) expression or activity is deleted or reduced in the genetically engineered bacterial cell as compared to a wild-type bacterial cell.

17. The method of claim 10, wherein beta-ketoacyl-CoA thiolase (fadl; EC 2.3.1.16) expression or activity is deleted or reduced in the genetically engineered bacterial cell as compared to a wild-type bacterial cell.

18. The method of claim 10, wherein fadJ (EC 5.1.2.3, 4.2.1.17, 1.1.1.35) expression or activity is deleted or reduced in the genetically engineered bacterial cell as compared to a wild-type bacterial cell.

* * * * *